(12) United States Patent
Bernett et al.

(10) Patent No.: US 11,358,999 B2
(45) Date of Patent: Jun. 14, 2022

(54) IL-12 HETERODIMERIC FC-FUSION PROTEINS

(71) Applicant: Xencor, Inc., Monrovia, CA (US)

(72) Inventors: Matthew Bernett, Monrovia, CA (US); John R. Desjarlais, Pasadena, CA (US); Rajat Varma, Hamden, CT (US); Ke Liu, Glendora, CA (US); Nargess Hassanzadeh-Kiabi, Pasadena, CA (US); Rumana Rashid, Temple City, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 16/592,656

(22) Filed: Oct. 3, 2019

(65) Prior Publication Data
US 2020/0216509 A1    Jul. 9, 2020

Related U.S. Application Data

(60) Provisional application No. 62/740,813, filed on Oct. 3, 2018, provisional application No. 62/810,038, filed on Feb. 25, 2019, provisional application No. 62/848,512, filed on May 15, 2019.

(51) Int. Cl.
| | |
|---|---|
| C07K 14/54 | (2006.01) |
| C07K 19/00 | (2006.01) |
| C07K 1/18 | (2006.01) |
| A61K 38/20 | (2006.01) |
| A61K 38/00 | (2006.01) |

(52) U.S. Cl.
CPC .......... *C07K 14/5434* (2013.01); *C07K 19/00* (2013.01); *A61K 38/00* (2013.01); *A61K 38/208* (2013.01); *C07K 1/18* (2013.01); *C07K 2319/30* (2013.01)

(58) Field of Classification Search
CPC ............... C07K 14/5435; C07K 19/00; C07K 2319/00; C07K 2319/30; A61K 38/208
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |

(Continued)

FOREIGN PATENT DOCUMENTS

| | | |
|---|---|---|
| EP | 0425235 B1 | 9/1996 |
| EP | 1418184 | 5/2004 |

(Continued)

OTHER PUBLICATIONS

Wells (1990) Biochemistry 29(37): 8509-8517.*
Ngo et al (1994) "The Protein Folding Problem and Tertiary Structure Prediction, Chapter 14: Computational Complexity Protein Structure Prediction, and the Levinthal Paradox" pp. 433-440 and 492-495 only.*
Bork (2000) Genome Research 10:398.*
Skolnicketal (2000) Trends in Biotech. 18(1): 34.*

(Continued)

*Primary Examiner* — Zachary C Howard
(74) *Attorney, Agent, or Firm* — Christopher J. Betti; Morgan, Lewis & Bockius, LLP

(57) ABSTRACT

The present invention provides novel IL-12 Fc fusion proteins, methods of making and using the same. The IL-12. Fc fusion proteins are useful for treatment of cancer and can be used in combination with checkpoint blockade.

2 Claims, 195 Drawing Sheets

Specification includes a Sequence Listing.

(56) References Cited

U.S. PATENT DOCUMENTS

| | | |
|---|---|---|
| 5,635,483 A | 6/1997 | Pettit et al. |
| 5,641,780 A | 6/1997 | Amishiro et al. |
| 5,650,492 A | 7/1997 | Gately et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umana et al. |
| 6,617,135 B1 | 9/2003 | Gillies et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,141,651 B2 | 11/2006 | Gillies et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 10,696,722 B2 | 6/2020 | Yong et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winkel |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0154453 A1 | 7/2007 | Webster et al. |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |

(56) References Cited

U.S. PATENT DOCUMENTS

| | | |
|---|---|---|
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |
| 2017/0247425 A1 | 8/2017 | Ungerechts et al. |
| 2017/0320947 A1 | 11/2017 | Moore et al. |
| 2018/0118828 A1 | 5/2018 | Bernett et al. |
| 2018/0118836 A1 | 5/2018 | Bernett et al. |
| 2018/0127501 A1 | 5/2018 | Bernett et al. |
| 2019/0010200 A1 | 1/2019 | Wang et al. |
| 2019/0169252 A1* | 6/2019 | Kim ................... A61P 35/00 |
| 2019/0263909 A1 | 8/2019 | Bernett et al. |
| 2019/0270816 A1 | 9/2019 | Bernett et al. |
| 2019/0382495 A1 | 12/2019 | Bernett et al. |
| 2019/0389954 A1 | 12/2019 | Bernett et al. |

FOREIGN PATENT DOCUMENTS

| | | |
|---|---|---|
| EP | 1752471 | 2/2007 |
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| KR | 1 00 827 757 B1 | 5/2008 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO1999029732 A2 | 6/1999 |
| WO | WO199937791 | 7/1999 |
| WO | WO99054440 | 10/1999 |
| WO | WO99066951 | 12/1999 |
| WO | WO200061739 A1 | 10/2000 |
| WO | WO2001007081 A1 | 2/2001 |
| WO | WO2001010912 | 2/2001 |
| WO | WO2001010912 A1 | 2/2001 |
| WO | WO200124763 A2 | 4/2001 |
| WO | WO200129246 A1 | 4/2001 |
| WO | WO200162931 A1 | 8/2001 |
| WO | WO2001058957 A2 | 8/2001 |
| WO | WO2001068802 A2 | 9/2001 |
| WO | WO200188138 | 11/2001 |
| WO | WO2001083525 | 11/2001 |
| WO | WO2001090192 | 11/2001 |
| WO | WO2002002143 A2 | 1/2002 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002066514 A2 | 8/2002 |
| WO | WO2002072605 A2 | 9/2002 |
| WO | WO2002083180 | 10/2002 |
| WO | WO2002098883 | 12/2002 |
| WO | WO2002066514 A3 | 2/2003 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007076933 A1 | 7/2007 |
| WO | WO2007084342 | 7/2007 |
| WO | WO2007084364 A2 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008134879 A1 | 11/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |

(56) References Cited

FOREIGN PATENT DOCUMENTS

| | | |
|---|---|---|
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011082301 A2 | 7/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013053775 A1 | 4/2013 |
| WO | WO2013055809 | 4/2013 |
| WO | WO2013063702 | 5/2013 |
| WO | WO2013090296 A1 | 6/2013 |
| WO | WO2013096828 | 6/2013 |
| WO | WO2013125667 | 8/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095249 A1 | 6/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016048903 A1 | 3/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016182751 | 11/2016 |
| WO | WO2017019846 | 2/2017 |
| WO | WO2017041739 A1 | 3/2017 |
| WO | WO2017062953 A1 | 4/2017 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2018030806 A1 | 2/2018 |
| WO | WO2018041838 | 3/2018 |
| WO | WO2018068008 A1 | 4/2018 |
| WO | WO2018213731 A1 | 11/2018 |
| WO | WO2019006472 | 1/2019 |
| WO | WO2019050521 | 3/2019 |
| WO | WO2019129053 | 7/2019 |
| WO | WO2020086758 | 4/2020 |

OTHER PUBLICATIONS

Doerks et al (1998) Trends in Genetics 14(6): 248.*
Brenner (1999) Trends in Genetics 15(4): 132.*
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologies Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., , Preparation, properties, and applications of carbohydrate conjugates of proteins and lipids, 1981, CRC Crit. Rev. Biochem., pp. 259-306.

(56) References Cited

OTHER PUBLICATIONS

Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Bhatt, Sea Lane—DDD presentation, "Surrobodies™ —A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163 .
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20.doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DBOB5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Immunotherapy with Long-Lived Anti-CD123 x Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.
Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.

(56) References Cited

OTHER PUBLICATIONS

Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins by T-Cell Epitope Modification, 2005, Dev. in Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) Complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina, Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2-CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7), pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.
Francois, et al., Construction of a Bispecific Antibody Reacting with the α- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.

(56) References Cited

OTHER PUBLICATIONS

Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.

Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.

Hakimuddin et al., A chemical method for the deglycosylation of proteins, 1987, Arch. Biochem. Biophys. 259:52.

Hamel, et al., The Role of the $V_L$- and $V_H$-Segments in the Preferential Reassociation of Immunoglobulin Subunits, Molecular Immunology, 1986, vol. 23, No. 5, pp. 503-510.

HAwkins et al., Selection of phage antibodies by binding affinity mimicking affinity maturation, 1992, J. Mol. Biol. 226:889-896.

Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.

He et al., Humanization and pharmacokinetics of a monoclonal antibody with specificity for both E- and P-selectin, 1998, J. Immunol. 160:1029-1035.

Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.

Hennecke et al., "Non-repetitive single-chain Fv linkers selected by selectively infective phage (SIP) technology.", Protein Eng. May 1998;11(5):405-10.

Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.

Hexham, et al., Influence of relative binding affinity on efficacy in a panel of anti-CD3 scFv immunotoxins, Molecular Immunology, 2001, vol. 38, pp. 397-408.

Hinman et al., Preparation and characterization of monoclonal antibody conjugates of the calicheamicins: a novel and potent family of antitumor antibodies, 1993 Cancer Res. 53:3336-3342.

Hoffmann, et al., Serial killing of tumor cells by cytotoxic T cells redirected with a CD19-/CD3-bispecific single-chain antibody construct, Int. J. Cancer, 2005, vol. 115, pp. 98-104.

Holliger et al., "Diabodies": Small Bivalent and bispecific antibody fragments, 1993, Proc. Natl. Acad. Sci. U.S.A. 90:6444-6448.

Holliger et al., Engineering bispecific antibodies, 1993, Current Opinion Biotechnol. 4:446-449.

Houtenbos, et al., The novel bispecific diabody αCD40/αCD28 strengthens leukaemic dendritic cell-induced T-cell reactivity, British Journal of Haematology, 2008, vol. 142, pp. 273-283.

Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.

Huston et al., Protein engineering antibody binding sites: recovery of specific activity in an antidigoxin single-chain Fv analogue produced in *Escherichia coli*, 1988, Proc. Natl. Acad. Sci. U.S.A. 85:5879-5883.

Igawa et al., Reduced elimination of IgG antibodies by engineering the variable region, 2010, PEDS. 23(5): 385-392.

Igawa, $V_H/V_L$ interface engineering to promote selective expression and inhibit conformational isomerization of thrombopoietin receptor agonist single-chain diabody. Protein Engineering, Design & Selection, 2010, vol. 23, No. 8, pp. 667-677.

Ishigaki et al., Impact of Plasma Oxidized Low-Density Lipoprotein Removal on Atherosclerosis., Circulation 118: 75-83, 2008.

Jackson et al., In vitro antibody maturation, 1995, J. Immunol. 154(7):3310-9.

Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.

Jefferis et al., Interaction sites on human IgG-Fc for FcγR: current models, 2002, Immunol Lett 82:57-65.

Jespers, et al., Crystal Structure of HEL4, a Soluble, Refoldable Human $V_H$ Single Domain with a Germ-line Scaffold, J. Mol. Biol., 2004, vol. 337, pp. 893-903.

Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.

Jin et al. The Design and Engineering of IgG-Like Bispecific Antibodies., Chapter 9, Bispecific Antibodies, pp. 151-169.

Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.

Johnson et al., Anti-tumor activity of CC49-doxorubicin immunoconguates, 1995, Anticancer Res. 15:1387-93.

Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.

Jones et al., Replacing the complementarity-determining regions in a human antibody with those from a mouse, 1986, Nature 321:522-525.

Jordan et al., Structural understanding of stabilization patterns in engineered bispecific Ig-like antibody molecules, Proteins 2009; 77:832-841, Jun. 19, 2009.

Jung, et al., Design of interchain disulfide bonds in the framework region of the Fv fragment of the monoclonal antibody B3, Proteins, 1994, vol. 19(1), pp. 35-47.

Jung, et al., Target Cell-restricted Triggering of the CD95 (APO-1/Fas) Death Receptor with Bispecific Antibody Fragments, Cancer Research, 2001, vol. 61, pp. 1846-1848.

Jungbluth et al., A monoclonal antibody recognizing human cancers with amplification/overexpression of the human epidermal growth factor receptor, 2003, Proc Natl Acad Sci U S A. 100(2):639-44.

Kabat et al., 1991, Sequences of proteins of immunological interest, Department of Health and Human Services, Bethesda, vol. 1, $5^{th}$ Ed.

Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.

Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

Kettleborough et al., Humanization of a mouse monoclonal antibody by CDR-grafting: the importance of framework residues on loop conformation, 1991, Protein Eng. 4(7):773-83.

Keyna, et al., Surrogate Light Chain-Dependent Selection of Ig Heavy Chain V Regions, J. Immunol., 1995, vol. 155, pp. 5536-5542.

Kharmate et al., Inhibition of tumor promoting signals by activation of SSTR2 and opioid receptors in human breast cancer cells., Cancer Cell Int. Sep. 23, 2013;13(1):93. doi:10.1186/1475-2867-13-93.

Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.

Kim et al., "Localization of the site of murine IgG1 molecule that is involved in binding the murine intestinal Fc receptor," Eur. J. Immunol., 24:2429-2434, 1994.

Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.

Kipriyanov, et al., Bispecific CD3 x CD19 Diabody for T Cell-Mediated Lysis of Malignant Human B Cells, Int. J. Cancer, 1998. Vol. 77, pp. 763-772.

(56) References Cited

OTHER PUBLICATIONS

Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol.2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyene antibiotic calicheamicins $o^7_1$ effectively suppress growth and dissemination of liver metastases in a syngeneic model of murine neuroblastoma, 1998, Cancer Res. 58:2928.
Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS-and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.Immunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

(56) References Cited

OTHER PUBLICATIONS

MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic & Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.
Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on IgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al, Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Merchant, et al., An efficient route to human bispecific IgG, Nature Biotechnology, 1998, vol. 16, pp. 677-681.
Mertens, Nico, "Tribodies: Fab-scFv fusion proteins as a platform to create multi-functional pharmaceuticals.", SpringerLink 2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idec Stability Engineering and Production of IgG-like Bispecifc Antibodies, AAPS National Biotechnology Conference, Jun. 24 to Jun. 27, 2007.
Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al., Phase I trial and tumour localization of the anti-EGFR monoclonal antibody ICR62 in head and neck or lung cancer, 1996, Br J Cancer, 73(2):228-35.
Modjtahedi et al., Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44 , pp. 1935-1943.
Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.

(56) References Cited

OTHER PUBLICATIONS

O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432. CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δand T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (-)-dolastatin 10.1 X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproinel, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp 76-136, 1965, Academic Press.
Senter et al., Proceedings of the American Association for Cancer Research, 2004, vol. 45, Abstract No. 623.

(56) References Cited

OTHER PUBLICATIONS

Senter, Potent antibody drug conjugates for cancer therapy, 2009, Current Opin. Chem. Biol. 13:235.

Sforzini et al., Targeting of saporin to Hodgkin's lymphoma cells by anti-CD30 and anti-CD25 bispecific antibodies., Br J Haematol. Sep. 1998;102(4):1061-8.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human $\alpha/\beta$ T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human Fc$\gamma$RIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Smith et al., Mouse model recapitulating human Fc$\gamma$ receptor structural and functional diversity., Proc Natl Acad Sci U S A. Apr. 17, 2012;109(16):6181-6. doi: 10.1073/pnas.1203954109. Epub Apr. 2, 2012.

Soumyarani et al., Oxidatively modified high density lipoprotein promotes inflammatory response in human monocytes-macrophages by enhanced production of ROS, TNF-$\alpha$, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.

Tarcsa et al, Chapter 10 Dual-Variable Domain Immunoglobulin (DVD-Ig™) Technology: A Versatile, Novel Format for the Next Generation of Dual-Targeting Biologies, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

Thotakura et al., Enzymatic deglycosylating of glycoproteins, 1987, Meth. Enzymol. 138:350.

Thurman et al., Detection of complement activation using monoclonal antibodies against C3d., J Clin Invest. May 2013;123(5):2218-30. doi: 10.1172/JCI65861. Epub Apr. 24, 2013.

Tomlinson et al., Methods for generating multivalent and bispecific antibody fragments, 2000, Methods Enzymol. 326:461-479.

Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.

Traunecker, et al., Bispecific single chain molecules (Janusins) target cytotoxic lymphocytes on HIV infected cells, The EMBO Journal, 1991, vol. 1, No. 12, pp. 3655-3659.

Tsurushita et al., Humanization of monoclonal antibodies, 2004, Molecular Biology of B Cells 533-545.

Umaña et al., Engineered glycoforms of an antineuro-blastoma IgG1 with optimized antibody-dependent cellular cytotoxic activity, 1999, Nat Biotechnol 17:176-180.

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

Van Boxel, et al., Some lessons from the systematic production and structural analysis of soluble $\alpha\beta$ T-cell receptors, Journal of Immunological Methods, 2009, vol. 350, pp. 14-21.

(56) References Cited

OTHER PUBLICATIONS

Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL—vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.
Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.
Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38: 313-319.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al., Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., *Annu Rev Biophys Bioeng*. 1984:13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Interv Aging. 2009;4:197-205. Epub May 14, 2009.

(56) References Cited

OTHER PUBLICATIONS

Sun et al., Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.
Zhang et al., The development of bispecific antibodies and their applications in tumor immune escape., Experimental Hematology & Oncology20176:12.
Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.
Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.
Masarova et al., Immune Checkpoint Approaches in AML and MDS: A Next Frontier?, The Journal of Targeted Therapies in Cancer, Mar. 6, 2017 (Mar. 6, 2017), XP002784099.
Scott et al., Antibody therapy of cancer., Nat Rev Cancer. Mar. 22, 2012;12(4):278-87. doi: 10.1038/nrc3236.
Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.
Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.
Fos et al., ICOS ligation recruits the p50alpha PI3K regulatory subunit to the immunological synapse., J Immunol. Aug. 1, 2008;181(3):1969-77.
Sanmamed et al.,Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004;34(5):1282-90.
Madrenas et al., Conversion of CTLA-4 from inhibitor to activator of T cells with a bispecific tandem single-chain Fv ligand., J Immunol. May 15, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09. 006.
Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.
Shields et al; "High Resolution Mapping of the Binding Site on Human IgG 1 for FcγRI, FcγRII, FcγRIII, and FcRn and Design of IgG1 Variants with Improved Binding to the FcγR*", The Journal of Biological Chemistry, 2001, 276(2):6591-6604.
Szymkowski et al; "Anti-CD38—anti-CD3 bispecific antibody in multiple myeloma", Xencor, pp. 1-15.
Julg, B. et al "Enhanced Anti-HIV Functional Activity Associated with Gag-Specific CD8 T-Cell Responses." Journal of Virology 84.11 (2010): 5540-5549. Web. Jul. 13, 2020.
Tutt et al., Trispecific F(ab')3 derivatives that use cooperative signaling via the TCR/CD3 complex and CD2 to activate and redirect resting cytotoxic T cells., The Journal of Immunology Jul. 1, 1991, 147 (1) 60-69.
Fallon et al., Enhanced antitumor effects by combining an IL-12/anti-DNA fusion protein with avelumab, an anti-PD-L1 antibody., Oncotarget, 2017, vol. 8, (No. 13), pp. 20558-20571.
Strauss et al., First-in-Human Phase I Trial of a Tumor-Targeted Cytokine (NHS-IL12) in Subjects with Metastatic Solid Tumors., Clinical Trials: Immunotherapy, Clin Cancer Res; 25(1) Jan. 1, 2019.
Holscher C: "The power of combinatorial immunology: IL-12 and IL-12-related dimeric cytokines in infectious diseases", Medical Microbiology and Immunology, Springer, Berlin, DE, vol. 193, No. 1, Jun. 27, 2003 (Jun. 27, 2003), pp. 1-17, XP002411766, ISSN: 1432-1831, DOI: 10.1007/S00430-003-0186-X.
Ha et al: "Immunoglobulin Fc Heterodimer Platform Technology: From Design to Applications in Therapeutic Antibodies and Proteins", Frontiers in Immunology, vol. 7, Oct. 6, 2016 (Oct. 6, 2016), pp. 1-16, XP055377975, DOI: 10.3389/fimmu.2016.00394.
Jung et al., Heterodimeric Fc-fused IL12 shows potent antitumor activity by generating memory CD8+ T cells., Oncoimmunology, 2018, vol. 7, No. 7, e1438800 (13 pages).
Kiefer et al., Immunocytokines and bispecific antibodies: two complementary strategies for the selective activation of immune cells at the tumor site., Immunol Rev Mar. 2016;270(1):178-92. doi: 10.1111/imr.12391.

\* cited by examiner

Figure 1A

Human IL-12 subunit alpha (IL-12p35) precursor sequence (SEQ ID NO:1)

\>sp|P29459
MCPARSLLLVATLVLLDHLSLARNLPVATPDPGMFPCLHHSQNLLRAVSNMLQKARQTLEFYPCTSEEIDHEDITKD
KTSTVEACLPLELTKNESCLNSRETSFITNGSCLASRKTSFMMALCLSSIYEDLKMYQVEFKTMNAKLLMDPKRQIF
LDQNMLAVIDELMQALNFNSETVPQKSSLEEPDFYKTKIKLCILLHAFRIRAVTIDRVMSYLNAS

Human IL-12 subunit alpha (IL-12p35) mature form sequence (SEQ ID NO:2)

\>sp|P29459|23-219
RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS

Human IL-12 subunit beta (IL-12p40) precursor sequence (SEQ ID NO:3)

\>sp|P29460
MCHQQLVISWFSLVFLASPLVAIWELKKDVYVVELDWYPDAPGEMVVLTCDTPEEDGITWTLDQSSEVLGSGKTLTI
QVKEFGDAGQYTCHKGGEVLSHSLLLLHKKEDGIWSTDILKDQKEPKNKTFLRCEAKNYSGRFTCWWLTTISTDLTF
SVKSSRGSSDPQGVTCGAATLSAERVRGDNKEYEYSVECQEDSACPAAEESLPIEVMVDAVHKLKYENYTSSFFIRD
IIKPDPPKNLQLKPLKNSRQVEVSWEYPDTWSTPHSYFSLTFCVQVQGKSKREKKDRVFTDKTSATVICRKNASISV
RAQDRYYSSSWSEWASVPCS0

Human IL-12 subunit beta (IL-12p40) mature form sequence (SEQ ID NO:4)

\>sp|P29460|23-328
IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

Human IL-12 receptor subunit beta-1 (IL-12Rß1) sequence (SEQ ID NO:5)

\>sp|P42701
MEPLVTWVVPLLFLFLLSRQGAACRTSECCFQDPPYPDADSGSASGPRDLRCYRISSDRYECSWQYEGPTAGVSHFL
RCCLSSGRCCYFAAGSATRLQFSDQAGVSVLYTVTLWVESWARNQTEKSPEVTLQLYNSVKYEPPLGDIKVSKLAGQ
LRMEWETPDNQVGAEVQFRHRTPSSPWKLGDCGPQDDDTESCLCPLEMNVAQEFQLRRRQLGSQGSSWSKWSSPVCV
PPENPPQPQVRFSVEQLGQDGRRRLTLKEQPTQLELPEGCQGLAPGTEVTYRLQLHMLSCPCKAKATRTLHLGKMPY
LSGAAYNVAVISSNQFGPGLNQTWHIPADTHTEPVALNISVGTNGTTMYWPARAQSMTYCIEWQPVGQDGGLATCSL
TAPQDPDPAGMATYSWSRESGAMGQEKCYYITIFASAHPEKLTLWSTVLSTYHFGGNASAAGTPHHVSVKNHSLDSV
SVDWAPSLLSTCPGVLKEYVVRCRDEDSKQVSEHPVQPTETQVTLSGLRAGVAYTVQVRADTAWLRGVWSQPQRFSI
EVQVSDWLIFFASLGSFLSILLVGVLGYLGLNRAARHLCPPLPTPCASSAIEFPGGKETWQWINPVDFQEEASLQEA
LVVEMSWDKGERTEPLEKTELPEGAPELALDTELSLEDGDRCKAKM

Human IL-12 receptor subunit beta-1 (IL-12Rß1), extracellular domain (SEQ ID NO:6)

\>sp|P42701|24-545
CRTSECCFQDPPYPDADSGSASGPRDLRCYRISSDRYECSWQYEGPTAGVSHFLRCCLSSGRCCYFAAGSATRLQFS
DQAGVSVLYTVTLWVESWARNQTEKSPEVTLQLYNSVKYEPPLGDIKVSKLAGQLRMEWETPDNQVGAEVQFRHRTP
SSPWKLGDCGPQDDDTESCLCPLEMNVAQEFQLRRRQLGSQGSSWSKWSSPVCVPPENPPQPQVRFSVEQLGQDGRR
RLTLKEQPTQLELPEGCQGLAPGTEVTYRLQLHMLSCPCKAKATRTLHLGKMPYLSGAAYNVAVISSNQFGPGLNQT
WHIPADTHTEPVALNISVGTNGTTMYWPARAQSMTYCIEWQPVGQDGGLATCSLTAPQDPDPAGMATYSWSRESGAM
GQEKCYYITIFASAHPEKLTLWSTVLSTYHFGGNASAAGTPHHVSVKNHSLDSVSVDWAPSLLSTCPGVLKEYVVRC
RDEDSKQVSEHPVQPTETQVTLSGLRAGVAYTVQVRADTAWLRGVWSQPQRFSIEVQVSD

Figure 1B

Human IL-12 receptor subunit beta-2 (IL-12Rß2) sequence (SEQ ID NO:7)

```
>sp|Q99665
MAHTFRGCSLAFMFIITWLLIKAKIDACKRGDVTVKPSHVILLGSTVNITCSLKPRQGCFHYSRRNKLILYKFDRRI
NFHHGHSLNSQVTGLPLGTTLFVCKLACINSDEIQICGAEIFVGVAPEQPQNLSCIQKGEQGTVACTWERGRDTHLY
TEYTLQLSGPKNLTWQKQCKDIYCDYLDFGINLTPESPESNFTAKVTAVNSLGSSSSLPSTFTFLDIVRPLPPWDIR
IKFQKASVSRCTLYWRDEGLVLLNRLRYRPSNSRLWNMVNVTKAKGRHDLLDLKPFTEYEFQISSKLHLYKGSWSDW
SESLRAQTPEEEPTGMLDVWYMKRHIDYSRQQISLFWKNLSVSEARGKILHYQVTLQELTGGKAMTQNITGHTSWTT
VIPRTGNWAVAVSAANSKGSSLPTRINIMNLCEAGLLAPRQVSANSEGMDNILVTWQPPRKDPSAVQEYVVEWRELH
PGGDTQVPLNWLRSRPYNVSALISENIKSYICYEIRVYALSGDQGGCSSILGNSKHKAPLSGPHINAITEEKGSILI
SWNSIPVQEQMGCLLHYRIYWKERDSNSQPQLCEIPYRVSQNSHPINSLQPRVTYVLWMTALTAAGESSHGNEREFC
LQGKANWMAFVAPSICIAIIMVGIFSTHYFQQKVFVLLAALRPQWCSREIPDPANSTCAKKYPIAEEKTQLPLDRLL
IDWPTPEDPEPLVISEVLHQVTPVFRHPPCSNWPQREKGIQGHQASEKDMMHSASSPPPPRALQAESRQLVDLYKVL
ESRGSDPKPENPACPWTVLPAGDLPTHDGYLPSNIDDLPSHEAPLADSLEELEPQHISLSVFPSSSLHPLTFSCGDK
LTLDQLKMRCDSLML
```

Human IL-12 receptor subunit beta-2 (IL-12Rß2), extracellular domain (SEQ ID NO:8)

```
>sp|Q99665|24-622
KIDACKRGDVTVKPSHVILLGSTVNITCSLKPRQGCFHYSRRNKLILYKFDRRINFHHGHSLNSQVTGLPLGTTLFV
CKLACINSDEIQICGAEIFVGVAPEQPQNLSCIQKGEQGTVACTWERGRDTHLYTEYTLQLSGPKNLTWQKQCKDIY
CDYLDFGINLTPESPESNFTAKVTAVNSLGSSSSLPSTFTFLDIVRPLPPWDIRIKFQKASVSRCTLYWRDEGLVLL
NRLRYRPSNSRLWNMVNVTKAKGRHDLLDLKPFTEYEFQISSKLHLYKGSWSDWSESLRAQTPEEEPTGMLDVWYMK
RHIDYSRQQISLFWKNLSVSEARGKILHYQVTLQELTGGKAMTQNITGHTSWTTVIPRTGNWAVAVSAANSKGSSLP
TRINIMNLCEAGLLAPRQVSANSEGMDNILVTWQPPRKDPSAVQEYVVEWRELHPGGDTQVPLNWLRSRPYNVSALI
SENIKSYICYEIRVYALSGDQGGCSSILGNSKHKAPLSGPHINAITEEKGSILISWNSIPVQEQMGCLLHYRIYWKE
RDSNSQPQLCEIPYRVSQNSHPINSLQPRVTYVLWMTALTAAGESSHGNEREFCLQGKAN
```

Figure 2A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 2B

| Monomer 1 | Monomer 2 |
| --- | --- |
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 2C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 2D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 2E

| Monomer 1 | Monomer 2 |
|---|---|
| K392D/K409D | E356K/D399K |
| K370D/K392D/K409D | E356K/E357K/D399K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| K247Q/R355Q/Q419E/K447_ | P217R/P228R/N276K |
| K247Q/R355Q/Q419E/K447_ | N276K |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 3

| Variant constant region | Substitutions |
|---|---|
| pI_ISO(-)-Fc only | K274Q/R355Q/N384S/K392N/V397M/Q419E/K447_ |
| pI_(-)_isosteric A-Fc only | Q295E/N384D/Q418E/N421D |
| pI_(-)_isosteric_B-Fc only | Q295E/Q418E/N421D |
| pI_ISO(+RR)-Fc only | P217R/P228R/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 4

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 5

| Monomer 1 (-) | Monomer 2 (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6

| Name | Sequence | SEQ ID NO: |
|---|---|---|
| (GGGGS)$_1$ or GGGGS | GGGGS | 9 |
| (GGGGS)$_2$ | GGGGSGGGGS | 10 |
| (GGGGS)$_3$ | GGGGSGGGGSGGGGS | 11 |
| (GGGGS)$_4$ | GGGGSGGGGSGGGGSGGGGS | 12 |
| (GGGGS)$_5$ | GGGGSGGGGSGGGGSGGGGSGGGGS | 13 |
| (GGGGS)$_6$ | GGGGSGGGGSGGGGSGGGGSGGGGSGGGGS | 14 |
| (GGGGS)$_7$ | GGGGSGGGGSGGGGSGGGGSGGGGSGGGGSGGGGS | 15 |
| (GGGGA)$_1$ or GGGGA | GGGGA | 247 |
| (GGGGA)$_2$ | GGGGAGGGGA | 248 |
| (GGGGA)$_3$ | GGGGAGGGGAGGGGA | 249 |
| (GGGGA)$_4$ | GGGGAGGGGAGGGGAGGGGA | 250 |
| (GGGGA)$_5$ | GGGGAGGGGAGGGGAGGGGAGGGGA | 251 |
| (GGGGA)$_6$ | GGGGAGGGGAGGGGAGGGGAGGGGAGGGGA | 252 |
| (GGGGA)$_7$ | GGGGAGGGGAGGGGAGGGGAGGGGAGGGGAGGGGA | 253 |
| 30AA-linker | DPALVHQRPAPPGGGGSGGGGSGGGGSGGG | 16 |
| (GKPGS)$_1$ or GKPGS | GKPGS | 17 |
| (GKPGS)$_5$ | GKPGSGKPGSGKPGSGKPGSGKPGS | 18 |
| (GKPGS)$_6$ | GKPGSGKPGSGKPGSGKPGSGKPGSGKPGS | 19 |
| (GGGES)$_1$ or GGGES | GGGES | 20 |

Figure 7A

Backbone 1

>Backbone 1 monomer 1 (SEQ ID NO:21)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCS
VMHEALHNHYTQKSLSLSPGK >Backbone 1 monomer 2 (SEQ ID NO:22)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRE
EMTKNQVSLTCDVSGFYPSDIAVEWESDGQPENNYKTTPPVLDSDGSFFLYSKLTVDKSRWEQGDVFSCS
VMHEALHNHYTQKSLSLSPGK

Backbone 2

>Backbone 2 monomer 1 (SEQ ID NO:23)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
EMTKNQVKLTCLVKGFYPSDIAVEWESNGQPENNYKTTPPVLDSDGSFFLYSKLTVDKSRWQQGNVFSCS
VMHEALHNHYTQKSLSLSPGK >Backbone monomer 2 (SEQ ID NO:24)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRE
EMTKNQVSLTCDVSGFYPSDIAVEWESDGQPENNYKTTPPVLDSDGSFFLYSKLTVDKSRWEQGDVFSCS
VMHEALHNHYTQKSLSLSPGK

Backbone 3

>Backbone 3 monomer 1 (SEQ ID NO:25)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
EMTKNQVKLTCLVKGFYPSDIAVEWESNGQPENNYKTTPPVLDSDGSFFLYSKLTVDKSRWQQGNVFSCS
VMHEALHNHYTQKSLSLSPGK >Backbone 3 monomer 2 (SEQ ID NO:26)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRE
EMTKNQVSLTCEVSGFYPSDIAVEWESDGQPENNYKTTPPVLDSDGSFFLYSKLTVDKSRWEQGDVFSCS
VMHEALHNHYTQKSLSLSPGK

Figure 7B

Backbone 4

\>Backbone 4 monomer 1 (SEQ ID NO:27)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSKGSFFLYSKLTVDKSRWQQGNVFSCS
VMHEALHNHYTQKSLSLSPGK \>Backbone 4 monomer 2 (SEQ ID NO:28)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRE
EMTENEVSLTCLVKGFYPSDIAVEWESDGQPENNYKTTPPVLDSDGSFFLYSKLEVDKSRWEQGDVFSCS
VMHEALHNHYTQKSLSLSPGK

Backbone 5

\>Backbone 5 monomer 1 (SEQ ID NO:29)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRD
QLTKNQVKLTCLVKGFYPSDIAVEWESNGQPENNYKTTPPVLDSDGSFFLYSKLTVDKSRWQQGNVFSCS
VMHEALHNHYTQKSLSLSPGK \>Backbone 5 monomer 2 (SEQ ID NO:30)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRD
ELTKNQVSLTCDVSGFYPSDIAVEWESDGQPENNYKTTPPVLDSDGSFFLYSKLTVDKSRWEQGDVFSCS
VMHEALHNHYTQKSLSLSPGK

Backbone 6

\>Backbone 6 monomer 1 (SEQ ID NO:31)
EPKSSDKTHTCPPCPAPPVAGPSVFLFPPKPKDTLMISRTPEVTCVVVDVKHEDPEVKFNWYVDGVEVHN
AKTKPREEQYASTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCS
VMHEALHNHYTQKSLSLSPGK \>Backbone 6 monomer 2 (SEQ ID NO:32)
EPKSSDKTHTCPPCPAPPVAGPSVFLFPPKPKDTLMISRTPEVTCVVVDVKHEDPEVKFNWYVDGVEVHN
AKTKPREEEYASTYRVVSVLTVLHQDWLNGKEYKCKVSNKALPAPIEKTISKAKGQPREPQVYTLPPSRE
EMTKNQVSLTCDVSGFYPSDIAVEWESDGQPENNYKTTPPVLDSDGSFFLYSKLTVDKSRWEQGDVFSCS
VMHEALHNHYTQKSLSLSPGK

Figure 7C

Backbone 7

>Backbone 7 monomer 1 (SEQ ID NO:33)
EPKSSDKTHTCPPCPAPPVAGPSVFLFPPKPKDTLMISRTPEVTCVVVDVKHEDPEVKFNWYVDGVEVHN
AKTKPREEQYSSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCS
VMHEALHNHYTQKSLSLSPGK >Backbone 7 monomer 2 (SEQ ID NO:34)
EPKSSDKTHTCPPCPAPPVAGPSVFLFPPKPKDTLMISRTPEVTCVVVDVKHEDPEVKFNWYVDGVEVHN
AKTKPREEEYSSTYRVVSVLTVLHQDWLNGKEYKCKVSNKALPAPIEKTISKAKGQPREPQVYTLPPSRE
EMTKNQVSLTCDVSGFYPSDIAVEWESDGQPENNYKTTPPVLDSDGSFFLYSKLTVDKSRWEQGDVFSCS
VMHEALHNHYTQKSLSLSPGK

Backbone 8

>Backbone 8 monomer 1 (SEQ ID NO:35)
ESKYGPPCPPCPAPEFLGGPSVFLFPPKPKDTLMISRTPEVTCVVVDVSQEDPEVQFNWYVDGVEVHNAK
TKPREEQFNSTYRVVSVLTVLHQDWLNGKEYKCKVSNKGLPSSIEKTISKAKGQPREPQVYTLPPSQEQM
TKNQVKLTCLVKGFYPSDIAVEWESNGQPENNYKTTPPVLDSDGSFFLYSRLTVDKSRWQEGNVFSCSVM
HEALHNHYTQKSLSLSLGK >Backbone 8 monomer 2 (SEQ ID NO:36)
ESKYGPPCPPCPAPEFLGGPSVFLFPPKPKDTLMISRTPEVTCVVVDVSQEDPEVQFNWYVDGVEVHNAK
TKPREEEFNSTYRVVSVLTVLHQDWLNGKEYKCKVSNKGLPSSIEKTISKAKGQPREPQVYTLPPSQEEM
TKNQVSLTCDVSGFYPSDIAVEWESDGQPENNYKTTPPVLDSDGSFFLYSRLTVDKSRWEEGDVFSCSVM
HEALHNHYTQKSLSLSLGK

Backbone 9

>Backbone 9 monomer 1 (SEQ ID NO:37)
ERKCCVECPPCPAPPVAGPSVFLFPPKPKDTLMISRTPEVTCVVVDVSHEDPEVQFNWYVDGVEVHNAKT
KPREEQFNSTFRVVSVLTVVHQDWLNGKEYKCKVSNKGLPAPIEKTISKTKGQPREPQVYTLPPSREQMT
KNQVKLTCLVKGFYPSDIAVEWESNGQPENNYKTTPPMLDSDGSFFLYSKLTVDKSRWQQGNVFSCSVMH
EALHNHYTQKSLSLSPGK >Backbone 9 monomer 2 (SEQ ID NO:38)
ERKCCVECPPCPAPPVAGPSVFLFPPKPKDTLMISRTPEVTCVVVDVSHEDPEVQFNWYVDGVEVHNAKT
KPREEEFNSTFRVVSVLTVVHQDWLNGKEYKCKVSNKGLPAPIEKTISKTKGQPREPQVYTLPPSREEMT
KNQVSLTCDVSGFYPSDIAVEWESDGQPENNYKTTPPMLDSDGSFFLYSKLTVDKSRWEQGDVFSCSVMH
EALHNHYTQKSLSLSPGK

Figure 7D

Backbone 10

>Backbone 10 monomer 1 (SEQ ID NO:39)
ERKCCVECPPCPAPPVAGPSVFLFPPKPKDTLMISRTPEVTCVVVDVKHEDPEVQFNWYVDGVEVHNAKT
KPREEQFNSTFRVVSVLTVVHQDWLNGKEYKCKVSNKGLPAPIEKTISKTKGQPREPQVYTLPPSREQMT
KNQVKLTCLVKGFYPSDIAVEWESNGQPENNYKTTPPMLDSDGSFFLYSKLTVDKSRWQQGNVFSCSVMH
EALHNHYTQKSLSLSPGK >Backbone 10 monomer 2 (SEQ ID NO:40)
ERKCCVECPPCPAPPVAGPSVFLFPPKPKDTLMISRTPEVTCVVVDVKHEDPEVQFNWYVDGVEVHNAKT
KPREEEFNSTFRVVSVLTVVHQDWLNGKEYKCKVSNKGLPAPIEKTISKTKGQPREPQVYTLPPSREEMT
KNQVSLTCDVSGFYPSDIAVEWESDGQPENNYKTTPPMLDSDGSFFLYSKLTVDKSRWEQGDVFSCSVMH
EALHNHYTQKSLSLSPGK

Backbone 11

>Backbone 11 monomer 1 (SEQ ID NO:41)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCS
VLHEALHSHYTQKSLSLSPGK >Backbone 11 monomer 2 (SEQ ID NO:42)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRE
EMTKNQVSLTCDVSGFYPSDIAVEWESDGQPENNYKTTPPVLDSDGSFFLYSKLTVDKSRWEQGDVFSCS
VLHEALHSHYTQKSLSLSPGK

Backbone 12

>Backbone 12 monomer 1 (SEQ ID NO:43)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCS
VMHEALHNHYTQKSLSLSPGK >Backbone 12 monomer 2 (SEQ ID NO:44)
EPKSSDKTHTCPPCPAPPVAGPSVFLFPPKPKDTLMISRTPEVTCVVVDVKHEDPEVKFNWYVDGVEVHN
AKTKPREEQYNSTYRVVSVLTVLHQDWLNGKEYKCKVSNKALPAPIEKTISKAKGQPREPQVYTLPPSRE
EMTKNQVSLTCLVKGFYPSDIAVEWESNGQPENNYKTTPPVLDSDGSFFLYSKLTVDKSRWQQGNVFSCS
VMHEALHNHYTQKSLSLSPGK

Figure 7E

Backbone 13

>Backbone 13 monomer 1 (SEQ ID NO:45)
EPKSSDKTHTCPPCPAPPVAGPSVFLFPPKPKDTLMISRTPEVTCVVVDVKHEDPEVKFNWYVDGVEVHN
AKTKPREEEYNSTYRVVSVLTVLHQDWLNGKEYKCKVSNKALPAPIEKTISKAKGQPREPQVYTLPPSRE
EMTKNQVSLTCDVSGFYPSDIAVEWESDGQPENNYKTTPPVLDSDGSFFLYSKLTVDKSRWEQGDVFSCS
VMHEALHNHYTQKSLSLSPGK >Backbone 13 monomer 2 (SEQ ID NO:46)
ERKSSDKTHTCPRCPAPPVAGPSVFLFPPKPKDTLMISRTPEVTCVVVDVKHEDPEVKFKWYVDGVEVHN
AKTKPREEQYNSTYRVVSVLTVLHQDWLNGKEYKCKVSNKALPAPIEKTISKAKGQPREPQVYTLPPSRE
QMTKNQVKLTCLVKGFYPSDIAVEWESNGQPENNYKTTPPVLDSDGSFFLYSKLTVDKSRWQQGNVFSCS
VMHEALHNHYTQKSLSLSPGK

IL-12-heteroFc
Example: XENP27201 heteroFc-IL-12
Example: XENP27202 scIL-12(p40/p35)-Fc
Example: XENP27203 scIL-12(p35/p40)-Fc
Example: XENP27204

Fc-scIL-12(p40/p35)

Fc-scIL-12(p35/p40)

Figure 9

**>XENP27201 human_IL12p40_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 - human_IL12p40_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:47)

Chain 2 - human_IL12p35_(GGGGS)2_Fc(216)_IgG1_C220S/PVA_/S267K/S364K/E357Q

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:48)

Figure 10

**>XENP27202 empty-Fc(216)_IgG1_pI(-
)_Isosteric_A_C220S/PVA_/S267K/L368D/K370S_(GGGGS)2_human_IL12p40-empty-
Fc(216)_IgG1_C220S/PVA_/S267K/S364K/E357Q_(GGGGS)2_human_IL12p35**

Chain 1 - empty-Fc(216)_IgG1_pI(-)_Isosteric_A_C220S/PVA_/S267K/L368D/K370S_(GGGGS)2_human_IL12p40

EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPG/
GGGGSGGGGS/IWELKKDVYVVELDWYPDAPGEMVVLTCDTPEEDGITWTLDQSSEVLGSGKTLTIQVKEFGDAGQY
TCHKGGEVLSHSLLLLHKKEDGIWSTDILKDQKEPKNKTFLRCEAKNYSGRFTCWWLTTISTDLTFSVKSSRGSSDP
QGVTCGAATLSAERVRGDNKEYEYSVECQEDSACPAAEESLPIEVMVDAVHKLKYENYTSSFFIRDIIKPDPPKNLQ
LKPLKNSRQVEVSWEYPDTWSTPHSYFSLTFCVQVQGKSKREKKDRVFTDKTSATVICRKNASISVRAQDRYYSSSW
SEWASVPCS (SEQ ID NO:49)

Chain 2 - human_IL12p40-empty-Fc(216)_IgG1_C220S/PVA_/S267K/S364K/E357Q_(GGGGS)2_human_IL12p35

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPG/
GGGGSGGGGS/RNLPVATPDPGMFPCLHHSQNLLRAVSNMLQKARQTLEFYPCTSEEIDHEDITKDKTSTVEACLPL
ELTKNESCLNSRETSFITNGSCLASRKTSFMMALCLSSIYEDLKMYQVEFKTMNAKLLMDPKRQIFLDQNMLAVIDE
LMQALNFNSETVPQKSSLEEPDFYKTKIKLCILLHAFRIRAVTIDRVMSYLNAS (SEQ ID NO:50)

Figure 11

>XENP27203 human_IL12p40_(GGGGS)5-human_IL12p35_(GGGGS)2_(single-Chain )-empty-Fc_Fc(216)_IgG1_pI(-)_Isosteric_A_C220S/PVA_/S267K/L368D/K370S-Fc(216)_IgG1_C220S/PVA_/S267K/S364K/E357Q

*Chain 1 - human_IL12p40_(GGGGS)5-human_IL12p35_(GGGGS)2_(single-Chain )_Fc(216)_IgG1_pI(-)_Isosteric_A_C220S/PVA_/S267K/L368D/K370S*

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGSGGGGSGGGGSGGGGS</u>/RNLPVATPDPGMFPCLHHSQNLLRAVSNMLQKARQTLEFYPCTSEEIDHEDI
TKDKTSTVEACLPLELTKNESCLNSRETSFITNGSCLASRKTSFMMALCLSSIYEDLKMYQVEFKTMNAKLLMDPKR
QIFLDQNMLAVIDELMQALNFNSETVPQKSSLEEPDFYKTKIKLCILLHAFRIRAVTIDRVMSYLNAS/<u>GGGGSGGG
GS</u>/EPKSSDKTHTCPPCPAPPVAGPSVFLFPPKPKDTLMISRTPEVTCVVVDVKHEDPEVKFNWYVDGVEVHNAKTK
PREEEYNSTYRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNHYTQKSLSLS
PGK (SEQ ID NO:51)

*Chain 2 - empty-Fc(216)_IgG1_C220S/PVA_/S267K/S364K/E357Q*

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK
(SEQ ID NO:52)

>XENP27204 human_IL12p35_(GGGGS)5-human_IL12p40_(GGGGS)2_(single-Chain )-empty-Fc_Fc(216)_IgG1_pI(-)_Isosteric_A_C220S/PVA_/S267K/L368D/K370S-Fc(216)_IgG1_C220S/PVA_/S267K/S364K/E357Q

*Chain 1 - human_IL12p35_(GGGGS)5-human_IL12p40_(GGGGS)2_(single-Chain )_Fc(216)_IgG1_pI(-)_Isosteric_A_C220S/PVA_/S267K/L368D/K370S*

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGSGGGGSGGGGSGGGGS</u>/IWELKKD
VYVVELDWYPDAPGEMVVLTCDTPEEDGITWTLDQSSEVLGSGKTLTIQVKEFGDAGQYTCHKGGEVLSHSLLLLHK
KEDGIWSTDILKDQKEPKNKTFLRCEAKNYSGRFTCWWLTTISTDLTFSVKSSRGSSDPQGVTCGAATLSAERVRGD
NKEYEYSVECQEDSACPAAEESLPIEVMVDAVHKLKYENYTSSFFIRDIIKPDPPKNLQLKPLKNSRQVEVSWEYPD
TWSTPHSYFSLTFCVQVQGKSKREKKDRVFTDKTSATVICRKNASISVRAQDRYYSSSWSEWASVPCS/<u>GGGGSGGG
GS</u>/EPKSSDKTHTCPPCPAPPVAGPSVFLFPPKPKDTLMISRTPEVTCVVVDVKHEDPEVKFNWYVDGVEVHNAKTK
PREEEYNSTYRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVMHEALHNHYTQKSLSLS
PGK (SEQ ID NO:53)

*Chain 2 - empty-Fc(216)_IgG1_C220S/PVA_/S267K/S364K/E357Q*

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK
(SEQ ID NO:54)

Purification of eluate from Protein A Chromatography via Anion Exchange Chromatography aSEC-MALS Analytical AIEX

Figure 13A
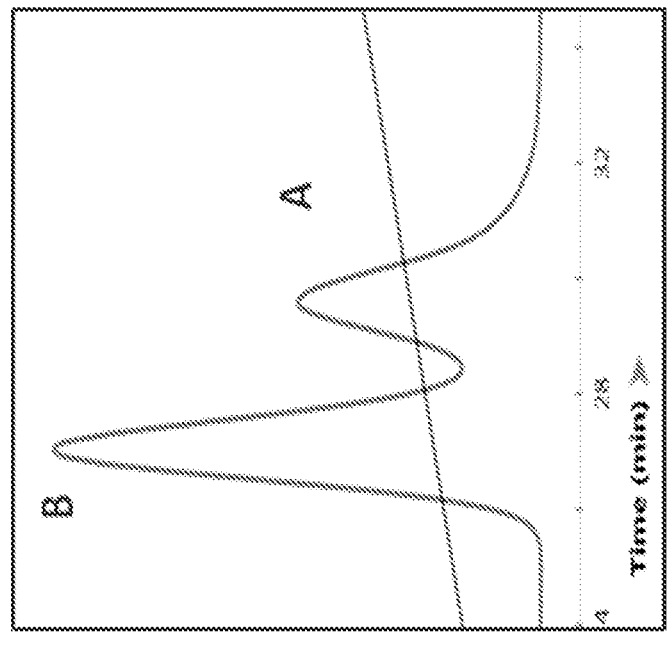
Purification of eluate from Protein A Chromatography via Anion Exchange Chromatography
Figure 13B
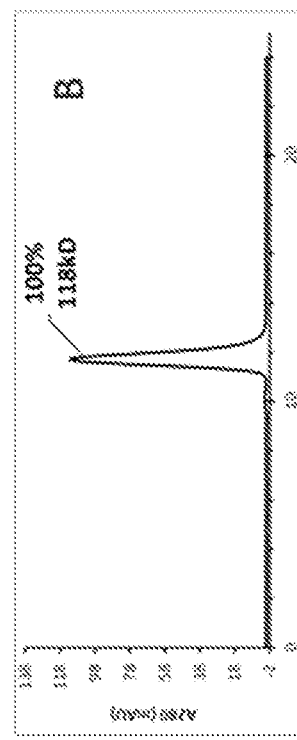
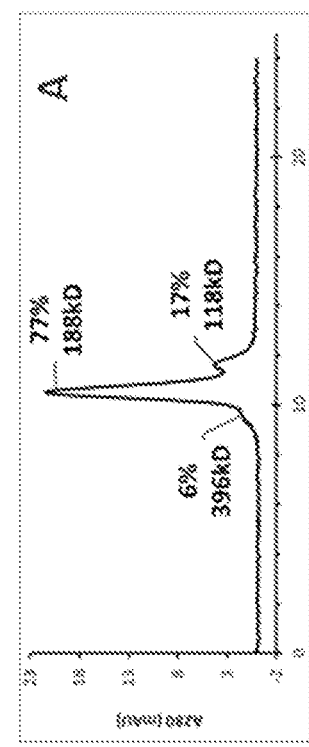
aSEC-MALS Analytical AIEX

Figure 14A

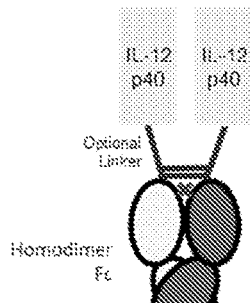

Bivalent IL-12p40-Fc
Example: XENP27560

Figure 14B

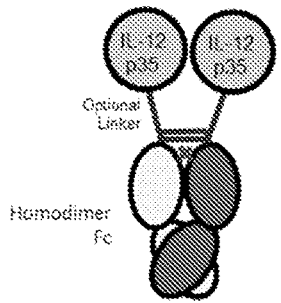

Bivalent IL-12p35-Fc
Example: XENP27561

Figure 15

>XENP27560 human_IL12p40_(GGGGS)2-Fc(216)_IgG1_pI(-)_Isosteric_A_C220S/PVA_/S267K/L368D/K370S_homodimer

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:55)

>XENP27561 human_IL12p35_(GGGGS)2_Fc(216)_IgG1_C220S/PVA_/S267K/S364K/E357Q_homodimer

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:56)

Figure 17

| RESIDUE |
| --- |
| W15 |
| P17 |
| D18 |
| A19 |
| P20 |
| G21 |
| M23 |
| L40 |
| D41 |
| Q42 |
| S43 |
| E45 |
| L47 |
| T54 |
| I55 |
| Q56 |
| K58 |
| E59 |
| F60 |
| G61 |
| D62 |
| Y66 |
| K84 |

Figure 18

| Residue | ASA | Residue | ASA |
|---|---|---|---|
| E3 | 85 | Q144 | 150 |
| D7 | 22 | E156 | 90 |
| E12 | 72 | D161 | 161 |
| D14 | 26 | N162 | 62 |
| D18 | 140 | E166 | 20 |
| E22 | 50 | E170 | 81 |
| D29 | 89 | Q172 | 72 |
| E32 | 80 | D174 | 93 |
| E33 | 113 | E187 | 63 |
| D41 | 54 | N200 | 57 |
| Q42 | 188 | D209 | 73 |
| E45 | 143 | D214 | 46 |
| Q56 | 105 | N218 | 67 |
| E59 | 86 | Q220 | 99 |
| D62 | 32 | N226 | 134 |
| Q65 | 75 | Q229 | 114 |
| E73 | 155 | E231 | 34 |
| E86 | 88 | E235 | 105 |
| D93 | 87 | Q256 | 104 |
| D97 | 22 | E262 | 147 |
| E100 | 148 | D265 | 60 |
| N103 | 86 | D270 | 58 |
| E110 | 41 | N281 | 71 |
| D129 | 71 | Q289 | 19 |
| D142 | 69 | E299 | 106 |

Figure 19

| RESIDUE | CONTACT TYPE |
|---|---|
| D87 | DIH |
| G88 | D |
| I89 | D |
| W90 | D |
| K104 | DA |
| F106 | D |

Figure 20A

> IL-12p40(N103D) (SEQ ID NO:57)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKDKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(N113D) (SEQ ID NO:58)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKDYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(N200D) (SEQ ID NO:59)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEDYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(N281D) (SEQ ID NO:60)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKDASISVRAQDRYYSSSWSEWASVPCS

> IL-12p40(N103D/N113D/N200D/N281D) (SEQ ID NO:61)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKDKTFLRCEAKDYSGRFTCWWLTTISTDLTFSVKSSRGSSDPQGVTCGAATLS
AERVRGDNKEYEYSVECQEDSACPAAEESLPIEVMVDAVHKLKYEDYTSSFFIRDIIKPDPPKNLQLKPLKNSRQVE
VSWEYPDTWSTPHSYFSLTFCVQVQGKSKREKKDRVFTDKTSATVICRKDASISVRAQDRYYSSSWSEWASVPCS

> IL-12p40(Q42E) (SEQ ID NO:62)

IWELKKDVYVVELDWYPDAPGEMVVLTCDTPEEDGITWTLDESSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E45Q) (SEQ ID NO:63)

IWELKKDVYVVELDWYPDAPGEMVVLTCDTPEEDGITWTLDQSSQVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

Figure 20B

> IL-12p40(Q56E) (SEQ ID NO:64)

IWELKKDVYVVELDWYPDAPGEMVVLTCDTPEEDGITWTLDQSSEVLGSGKTLTIEVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E59Q) (SEQ ID NO:65)

IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(D62N) (SEQ ID NO:66)

IWELKKDVYVVELDWYPDAPGEMVVLTCDTPEEDGITWTLDQSSEVLGSGKTLTIQVKEFGNAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(Q42E/E45Q) (SEQ ID NO:67)

IWELKKDVYVVELDWYPDAPGEMVVLTCDTPEEDGITWTLDESSQVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E45Q/Q56E) (SEQ ID NO:68)

IWELKKDVYVVELDWYPDAPGEMVVLTCDTPEEDGITWTLDQSSQVLGSGKTLTIEVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(Q42E/E59Q) (SEQ ID NO:69)

IWELKKDVYVVELDWYPDAPGEMVVLTCDTPEEDGITWTLDESSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(Q56E/E59Q) (SEQ ID NO:70)

IWELKKDVYVVELDWYPDAPGEMVVLTCDTPEEDGITWTLDQSSEVLGSGKTLTIEVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

Figure 20C

> IL-12p40(Q42E/E45Q/Q56E) (SEQ ID NO:71)

IWELKKDVYVVELDWYPDAPGEMVVLTCDTPEEDGITWTLDESSQVLGSGKTLTIEVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E45Q/Q56E/E59Q) (SEQ ID NO:72)

IWELKKDVYVVELDWYPDAPGEMVVLTCDTPEEDGITWTLDQSSQVLGSGKTLTIEVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(D161N) (SEQ ID NO:73)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGNNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E73Q) (SEQ ID NO:74)

IWELKKDVYVVELDWYPDAPGEMVVLTCDTPEEDGITWTLDQSSEVLGSGKTLTIQVKEFGDAGQYTCHKGGQVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(Q144E) (SEQ ID NO:75)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPEGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E262Q) (SEQ ID NO:76)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKRQKKDRVFTDKTSATVICRKNASISVRAQDRYYSSSWSEWASVPCS

> IL-12p40(E100Q) (SEQ ID NO:77)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKQPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

Figure 20D

> IL-12p40(D18N) (SEQ ID NO:78)

IWELKKDVYVVELDWYPNAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(E33Q) (SEQ ID NO:79)

IWELKKDVYVVELDWYPDAPGEMVVLTCDTPEQDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

> IL-12p40(Q229E) (SEQ ID NO:80)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSREVE
VSWEYPDTWSTPHSYFSLTFCVQVQGKSKREKKDRVFTDKTSATVICRKNASISVRAQDRYYSSSWSEWASVPCS

> IL-12p40(E235Q) (SEQ ID NO:81)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWQYPDTWSTPHSYFSLTFCVQVQGKSKREKKDRVFTDKTSATVICRKNASISVRAQDRYYSSSWSEWASVPCS

> IL-12p40(Q256N) (SEQ ID NO:82)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVNGKSKREKKDRVFTDKTSATVICRKNASISVRAQDRYYSSSWSEWASVPCS

> IL-12p40(E299Q) (SEQ ID NO:83)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSQWASVPCS

> IL-12p40(D87N) (SEQ ID NO:84)

IWELKKDVYVVELDWYPDAPGEMVVLTCDTPEEDGITWTLDQSSEVLGSGKTLTIQVKEFGDAGQYTCHKGGEVLSH
SLLLLHKKENGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS

Figure 20E

> IL-12p40(N103D/N113D) (SEQ ID NO: 254)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKDKTFLRCEAKDYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N103D/N200D) (SEQ ID NO: 255)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKDKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYEDYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N103D/N281D) (SEQ ID NO: 256)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKDKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKDASISVRAQDRYYSSSWSEWASVPCS

> IL-12p40(N113D/N200D) (SEQ ID NO: 257)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKDYSGRFTCWWLTTISTDLTFSVKSSRGSSDPQGVTCGAATLSAERVR
GDNKEYEYSVECQEDSACPAAEESLPIEVMVDAVHKLKYEDYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N113D/N281D) (SEQ ID NO: 258)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKDYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKDASISVRAQDRYYSSSWSEWASVPCS

> IL-12p40(N200D/N281D) (SEQ ID NO: 259)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYEDYTSSFFIRDIIKPDPPKNLQLKPLKNSRQVEVSWEYPDT
WSTPHSYFSLTFCVQVQGKSKREKKDRVFTDKTSATVICRKDASISVRAQDRYYSSSWSEWASVPCS

Figure 20F

> IL-12p40(N103D/N113D/N200D) (SEQ ID NO: 260)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKDKTFLRCEAKDYSGRFTCWWLTTISTDLTFSVKSSRGSSDPQGVTCGAATLSAERVR
GDNKEYEYSVECQEDSACPAAEESLPIEVMVDAVHKLKYEDYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N103D/N113D/N281D) (SEQ ID NO: 261)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKDKTFLRCEAKDYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKDASISVRAQDRYYSSSWSEWASVPCS

> IL-12p40(N103D/N200D/N281D) (SEQ ID NO: 262)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKDKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYEDYTSSFFIRDIIKPDPPKNLQLKPLKNSRQVEVSWEYPDT
WSTPHSYFSLTFCVQVQGKSKREKKDRVFTDKTSATVICRKDASISVRAQDRYYSSSWSEWASVPCS

> IL-12p40(N113D/N200D/N281D) (SEQ ID NO: 263)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKDYSGRFTCWWLTTISTDLTFSVKSSRGSSDPQGVTCGAATLSAERVR
GDNKEYEYSVECQEDSACPAAEESLPIEVMVDAVHKLKYEDYTSSFFIRDIIKPDPPKNLQLKPLKNSRQVEVSWEYPDT
WSTPHSYFSLTFCVQVQGKSKREKKDRVFTDKTSATVICRKDASISVRAQDRYYSSSWSEWASVPCS

> IL-12p40(N103Q) (SEQ ID NO: 264)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N113Q) (SEQ ID NO: 265)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

Figure 20G

> IL-12p40(N200Q) (SEQ ID NO: 266)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N281Q) (SEQ ID NO: 267)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

> IL-12p40(N103Q/N113Q) (SEQ ID NO: 268)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N103Q/N200Q) (SEQ ID NO: 269)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N103Q/N281Q) (SEQ ID NO: 270)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

> IL-12p40(N113Q/N200Q) (SEQ ID NO: 271)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

Figure 20H

> IL-12p40(N113Q/N281Q) (SEQ ID NO: 272)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

> IL-12p40(N200Q/N281Q) (SEQ ID NO: 273)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

> IL-12p40(N103Q/N113Q/N200Q) (SEQ ID NO: 274)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS

> IL-12p40(N103Q/N113Q/N281Q) (SEQ ID NO: 275)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

> IL-12p40(N103Q/N200Q/N281Q) (SEQ ID NO: 276)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

> IL-12p40(N113Q/N200Q/N281Q) (SEQ ID NO: 277)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

Figure 20I

> IL-12p40(N103Q/N113Q/N200Q/N281Q) (SEQ ID NO: 278)

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKQKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYPDT
WSTPHSYFSLTFCVQVQGKSKREKKDRVFTDKTSATVICRKQASISVRAQDRYYSSSWSEWASVPCS

Figure 21A

>XenD24752 human_IL12p40_N103D_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK*
*GGEVLSHSLLLLHKKEDGIWSTDILKDQKEPKDKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\<u>GGGGSGGGGS</u>\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:85)

>XenD24753 human_IL12p40_N113D_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK*
*GGEVLSHSLLLLHKKEDGIWSTDILKDQKEPKNKTFLRCEAKDYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\<u>GGGGSGGGGS</u>\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:86)

>XenD24754 human_IL12p40_N200D_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK*
*GGEVLSHSLLLLHKKEDGIWSTDILKDQKEPKNKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYEDYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\<u>GGGGSGGGGS</u>\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:87)

Figure 21B

>XenD24755 human_IL12p40_N281D_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK*
*GGEVLSHSLLLLHKKEDGIWSTDILKDQKEPKNKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*DASISVRAQDRYYSSSWSEWASVPCS\*<u>GGGGSGGGGS</u>*\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:88)

>XenD24756 human_IL12p40_N103D/N113D/N200D/N281D_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK*
*GGEVLSHSLLLLHKKEDGIWSTDILKDQKEPKDKTFLRCEAKDYSGRFTCWWLTTISTDLTFSVKSSRGS*
*SDPQGVTCGAATLSAERVRGDNKEYEYSVECQEDSACPAAEESLPIEVMVDAVHKLKYEDYTSSFFIRDI*
*IKPDPPKNLQLKPLKNSRQVEVSWEYPDTWSTPHSYFSLTFCVQVQGKSKREKKDRVFTDKTSATVICRK*
*DASISVRAQDRYYSSSWSEWASVPCS\*<u>GGGGSGGGGS</u>*\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:89)

>XenD24757 human_IL12p40_Q42E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDESSEVLGSGKTLTIQVKEFGDAGQYTCHK*
*GGEVLSHSLLLLHKKEDGIWSTDILKDQKEPKNKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\*<u>GGGGSGGGGS</u>*\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:90)

Figure 21C

>XenD24758 human_IL12p40_E45Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSQVLGSKTLTIQVKEFGDAGQYTCHK*
*GGEVLSHSLLLLHKKEDGIWSTDILKDQKEPKNKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\<u>GGGGSGGGGS</u>\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:91)

>XenD24759 human_IL12p40_Q56E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIEVKEFGDAGQYTCHK*
*GGEVLSHSLLLLHKKEDGIWSTDILKDQKEPKNKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\<u>GGGGSGGGGS</u>\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:92)

>XenD24760 human_IL12p40_E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTCHK*
*GGEVLSHSLLLLHKKEDGIWSTDILKDQKEPKNKTFLRCEAKNYSGRFTCWWLTTISTDLTFSVKSSRGS*
*SDPQGVTCGAATLSAERVRGDNKEYEYSVECQEDSACPAAEESLPIEVMVDAVHKLKYENYTSSFFIRDI*
*IKPDPPKNLQLKPLKNSRQVEVSWEYPDTWSTPHSYFSLTFCVQVQGKSKREKKDRVFTDKTSATVICRK*
*NASISVRAQDRYYSSSWSEWASVPCS\<u>GGGGSGGGGS</u>\EPKSSDKTHTCPPCPAPPVAGPSVFLFPPKPK*
*DTLMISRTPEVTCVVVDVKHEDPEVKFNWYVDGVEVHNAKTKPREEEYNSTYRVVSVLTVLHQDWLNGKE*
*YKCKVSNKALPAPIEKTISKAKGQPREPQVYTLPPSREEMTKNQVSLTCDVSGFYPSDIAVEWESDGQPE*
*NNYKTTPPVLDSDGSFFLYSKLTVDKSRWEQGDVFSCSVMHEALHNHYTQKSLSLSPGK* (SEQ ID NO:93)

Figure 21D

**>XenD24761 human_IL12p40_D62N_(GGGGS)2-Fc(216)_IgG1_pI(-
) Isosteric_A_C220S/PVA_/S267K/L368D/K370S_pTT5**

*IWELKKDVYVVELDWYPDAPGEMVVLTCDTPEEDGITWTLDQSSEVLGSGKTLTIQVKEFGNAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\*EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:94)

**>XenD24762 human_IL12p40_Q42E/E45Q_(GGGGS)2-Fc(216)_IgG1_pI(-
) Isosteric_A_C220S/PVA_/S267K/L368D/K370S_pTT5**

*IWELKKDVYVVELDWYPDAPGEMVVLTCDTPEEDGITWTLDESSQVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\*EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:95)

**>XenD24763 human_IL12p40_E45Q/Q56E_(GGGGS)2-Fc(216)_IgG1_pI(-
) Isosteric_A_C220S/PVA_/S267K/L368D/K370S_pTT5**

*IWELKKDVYVVELDWYPDAPGEMVVLTCDTPEEDGITWTLDQSSQVLGSGKTLTIEVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\*EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:96)

Figure 21E

>XenD24764 human_IL12p40_Q42E/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDESSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:97)

>XenD24765 human_IL12p40_Q56E/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIEVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:98)

>XenD24766 human_IL12p40_Q42E/E45Q/Q56E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDESSQVLGSGKTLTIEVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:99)

Figure 21F

>XenD24767_human_IL12p40_E45Q/Q56E/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSQVLGSGKTLTIEVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:100)

>XenD24768_human_IL12p40_D161N_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGNNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:101)

>XenD24769_human_IL12p40_E73Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGQVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:102)

Figure 21G

>XenD24770_human_IL12p40_Q144E_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPEGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:103)

>XenD24771_human_IL12p40_E262Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKRQKKDRVFTDKTSATVICRK
NASISVRAQDRYYSSSWSEWASVPCS\*<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:104)

>XenD24772_human_IL12p40_E100Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKQPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:105)

Figure 21H

>XenD24773_human_IL12p40_D18N_(GGGGS)2-Fc(216)_IgG1_pI(-
)_Isosteric_A_C220S/PVA_/S267K/L368D/K370S_pTT5

*IWELKKDVYVVELDWYPNAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:106)

>XenD24774_human_IL12p40_E33Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEQDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:107)

>XenD24775_human_IL12p40_Q229E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSREVEVSWEYPDTWSTPHSYFSLTFCVQVQGKSKREKKDRVFTDKTSATVICRK
NASISVRAQDRYYSSSWSEWASVPCS\*<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:108)

Figure 21I

>XenD24776 human_IL12p40_E235Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWQYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:109)

>XenD24777 human_IL12p40_Q256E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVEGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:110)

>XenD24778 human_IL12p40_E299Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSQWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:111)

Figure 21J

>XenD24792 human_IL12p40_D87N_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTCHK
GGEVLSHSLLLLHKKENGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\<u>GGGGSGGGGS</u>\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:112)

Figure 22

| Residue | ASA |
|---------|-----|
| Q35 | 134 |
| E38 | 159 |
| E46 | 145 |
| D55 | 159 |
| E67 | 140 |
| N71 | 103 |
| N76 | 119 |
| N85 | 151 |
| Q135 | 138 |
| Q146 | 124 |
| N151 | 144 |
| E153 | 189 |
| E162 | 114 |
| E163 | 112 |

RNLPVATPDPGMFPCLHHSQNLLRAVSNMLQKARQTLEFYPCTSEEIDHEDITKDKTSTVEACLPLELTKDESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO:113)

> IL-12p35(N85D)

RNLPVATPDPGMFPCLHHSQNLLRAVSNMLQKARQTLEFYPCTSEEIDHEDITKDKTSTVEACLPLELTKNESCLNS
RETSFITDGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO:114)

> IL-12p35(N195D)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLDAS (SEQ ID NO:115)

> IL-12p35(N71D/N85D/N195D)

RNLPVATPDPGMFPCLHHSQNLLRAVSNMLQKARQTLEFYPCTSEEIDHEDITKDKTSTVEACLPLELTKDESCLNS
RETSFITDGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLDAS (SEQ ID NO:116)

> IL-12p35(E153Q)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSQT
VPQKSSLEEPDFYKTKIKLCILLHAFRIRAVTIDRVMSYLNAS (SEQ ID NO:117)

> IL-12p35(E38Q)

RNLPVATPDPGMFPCLHHSQNLLRAVSNMLQKARQTLQFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO:118)

> IL-12p35(N151D)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS (SEQ ID NO:119)

> IL-12p35(Q135E)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDENMLAVIDELMQALNFNSET
VPQKSSLEEPDFYKTKIKLCILLHAFRIRAVTIDRVMSYLNAS (SEQ ID NO:120)

RNLPVATPDPGMFPCLHHSQNLLRAVSNMLQKARDTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO:121)

> IL-12p35(Q146E)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMEALNFNSET
VPQKSSLEEPDFYKTKIKLCILLHAFRIRAVTIDRVMSYLNAS (SEQ ID NO:122)

> IL-12p35(N76D)

RNLPVATPDPGMFPCLHHSQNLLRAVSNMLQKARQTLEFYPCTSEEIDHEDITKDKTSTVEACLPLELTKNESCLDS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO:123)

> IL-12p35(E162Q)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLQEPDFYKTKIKLCILLHAFRIRAVTIDRVMSYLNAS (SEQ ID NO:124)

> IL-12p35(E163Q)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEQPDFYKTKIKLCILLHAFRIRAVTIDRVMSYLNAS (SEQ ID NO:125)

> IL-12p35(N71Q)

RNLPVATPDPGMFPCLHHSQNLLRAVSNMLQKARQTLEFYPCTSEEIDHEDITKDKTSTVEACLPLELTKQESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO: 279)

> IL-12p35(N85Q)

RNLPVATPDPGMFPCLHHSQNLLRAVSNMLQKARQTLEFYPCTSEEIDHEDITKDKTSTVEACLPLELTKNESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO: 280)

> IL-12p35(N195Q)

RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS (SEQ ID NO: 281)

Figure 23C

> IL-12p35(N71Q/N85Q)
RNLPVATPDGMFPCLHHSQNLLRAVSNMLQKARQTLEFYPCTSEEIDHEDITKDKTSTVEACLPLELTKQESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO: 282)

> IL-12p35(N71Q/N195Q)
RNLPVATPDGMFPCLHHSQNLLRAVSNMLQKARQTLEFYPCTSEEIDHEDITKDKTSTVEACLPLELTKQESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS (SEQ ID NO: 283)

> IL-12p35(N85Q/N195Q)
RNLPVATPDGMFPCLHHSQNLLRAVSNMLQKARQTLEFYPCTSEEIDHEDITKDKTSTVEACLPLELTKNESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS (SEQ ID NO: 284)

> IL-12p35(N71Q/N85Q/N195Q)
RNLPVATPDGMFPCLHHSQNLLRAVSNMLQKARQTLEFYPCTSEEIDHEDITKDKTSTVEACLPLELTKQESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS (SEQ ID NO: 285)

> IL-12p35(N71D/N85D)
RNLPVATPDGMFPCLHHSQNLLRAVSNMLQKARQTLEFYPCTSEEIDHEDITKDKTSTVEACLPLELTKDESCLNS
RETSFITDGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS (SEQ ID NO: 286)

> IL-12p35(N71D/N195D)
RNLPVATPDGMFPCLHHSQNLLRAVSNMLQKARQTLEFYPCTSEEIDHEDITKDKTSTVEACLPLELTKDESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLDAS (SEQ ID NO: 287)

> IL-12p35(N85D/N195D)
RNLPVATPDGMFPCLHHSQNLLRAVSNMLQKARQTLEFYPCTSEEIDHEDITKDKTSTVEACLPLELTKNESCLNS
RETSFITDGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLDAS (SEQ ID NO: 288)

Figure 24A

>XenD24779
human_IL12p35_N71D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK*
*DESCLNSRETSFITNGSCLASRKTSFMMALCLSSIYEDLKMYQVEFKTMNAKLLMDPKRQIFLDQNMLAV*
*IDELMQALNFNSETVPQKSSLEEPDFYKTKIKLCILLHAFRIRAVTIDRVMSYLNAS*\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:126)

>XenD24780
human_IL12p35_N85D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK*
*NESCLNSRETSFITDGSCLASRKTSFMMALCLSSIYEDLKMYQVEFKTMNAKLLMDPKRQIFLDQNMLAV*
*IDELMQALNFNSETVPQKSSLEEPDFYKTKIKLCILLHAFRIRAVTIDRVMSYLNAS*\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:127)

>XenD24781
human_IL12p35_N195D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK*
*NESCLNSRETSFITNGSCLASRKTSFMMALCLSSIYEDLKMYQVEFKTMNAKLLMDPKRQIFLDQNMLAV*
*IDELMQALNFNSETVPQKSSLEEPDFYKTKIKLCILLHAFRIRAVTIDRVMSYLDAS*\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:128)

>XenD24782
human_IL12p35_N71D/N85D/N195D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK*
*DESCLNSRETSFITDGSCLASRKTSFMMALCLSSIYEDLKMYQVEFKTMNAKLLMDPKRQIFLDQNMLAV*
*IDELMQALNFNSETVPQKSSLEEPDFYKTKIKLCILLHAFRIRAVTIDRVMSYLDAS*\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:129)

Figure 24B

>XenD24783
human_IL12p35_E153Q_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSQTVPQKSSLEEPDFYKTKIKLCILLHAFRIRAVTIDRVMSYLNAS*\<ins>GGGGSGGGGS</ins>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:130)

>XenD24784
human_IL12p35_E38Q_(GGGGS)2_Fc(216)_IgG1_C220S/PVA_/S267K/S364K/E357Q_pTT5

*RNLPVATPDPGMFPCLHHSQNLLRAVSNMLQKARQTLQFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS*\<ins>GGGGSGGGGS</ins>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:131)

>XenD24785
human_IL12p35_N151D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQKSSLEEPDFYKTKIKLCILLHAFRIRAVTIDRVMSYLNAS*\<ins>GGGGSGGGGS</ins>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:132)

>XenD24786
human_IL12p35_Q135E_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDENMLAV
IDELMQALNFNSETVPQKSSLEEPDFYKTKIKLCILLHAFRIRAVTIDRVMSYLNAS*\<ins>GGGGSGGGGS</ins>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:133)

Figure 24C

>XenD24787
human_IL12p35_Q35D_(GGGGS)2_Fc(216)_IgG1_C220S/PVA_/S267K/S364K/E357Q_pTT5

*RNLPVATPDPGMFPCLHHSQNLLRAVSNMLQKARDTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:134)

>XenD24788
human_IL12p35_Q146E_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMEALNFNSETVPQKSSLEEPDFYKTKIKLCILLHAFRIRAVTIDRVMSYLNAS\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:135)

>XenD24789
human_IL12p35_N76D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLDSRETSFITNGSCLASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:136)

>XenD24790
human_IL12p35_E162Q_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLQEPDFYKTKIKLCILLHAFRIRAVTIDRVMSYLNAS\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:137)

Figure 24D

>XenD24791
human_IL12p35_E163Q_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLEQPDFYKTKIKLCILLHAFRIRAVTIDRVMSYLNAS\*<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:138)

Figure 25A

>XENP28820 human_IL12p40(N103D/N113D/N200D/N281D)_(GGGGS)2-
human_IL12p35(N71D/N85D/N195D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24756) - human_IL12p40_N103D/N113D/N200D/N281D_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKDKTFLRCEAKDYSGRFTCWWLTTISTDLTFSVKSSRGSSDPQGVTCGAATLS
AERVRGDNKEYEYSVECQEDSACPAAEESLPIEVMVDAVHKLKYEDYTSSFFIRDIIKPDPPKNLQLKPLKNSRQVE
VSWEYPDTWSTPHSYFSLTFCVQVQGKSKREKKDRVFTDKTSATVICRKDASISVRAQDRYYSSSWSEWASVPCS\G
GGGSGGGGS\*EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:139)

Chain 2 (XenD24782) -
human_IL12p35_N71D/N85D/N195D_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKDESCLNS
RETSFITDGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLDAS\GGGGSGGGGS\*EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:140)

>XENP28821 human_IL12p40(D87N)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24792) - human_IL12p40_D87N_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKENGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS\G
GGGSGGGGS\*EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:141)

Figure 25B

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:142)

**>XENP28822 human_IL12p40(Q42E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

**Chain 1 (XenD24757) - human_IL12p40_Q42E_(GGGGS)2-Fc(216)_IgG1_pI(-
)_Isosteric_A_C220S/PVA_/S267K/L368D/K370S**

*IWELKKDVYVVELDWYPDAPGEMVVLTCDTPEEDGITWTLDESSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:143)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:144)

**>XENP28823 human_IL12p40(E45Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

**Chain 1 (XenD24758) - human_IL12p40_E45Q_(GGGGS)2-Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSQVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:145)

Figure 25C

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:146)

**>XENP28824 human_IL12p40(Q56E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24759) - human_IL12p40_Q56E_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIEVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:147)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:148)

**>XENP28825 human_IL12p40(E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24760) - human_IL12p40_E59Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:149)

Figure 25D

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:150)

>XENP28826 human_IL12p40(D62N)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

Chain 1 (XenD24761) - human_IL12p40_D62N_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGNAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:151)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:152)

>XENP28827 human_IL12p40(Q42E/E45Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

Chain 1 (XenD24762) - human_IL12p40_Q42E/E45Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDESSQVLGSGKTLTIQVKEFGDAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:153)

Figure 25E

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:154)

**>XENP28828 human_IL12p40(E45Q/Q56E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24763) - human_IL12p40_E45Q/Q56E_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSQVLGSGKTLTIEVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:155)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:156)

**>XENP28829 human_IL12p40(Q42E/E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24764) - human_IL12p40_Q42E/E59Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDESSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:157)

Figure 25F

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS\GGGGSGGGGS\*EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:158)

>XENP28830 human_IL12p40(Q56E/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD24765) - human_IL12p40_Q56E/E59Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIEVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS\G
GGGSGGGGS\*EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:159)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS\GGGGSGGGGS\*EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:160)

>XENP28831 human_IL12p40(Q42E/E45Q/Q56E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD24766) - human_IL12p40_Q42E/E45Q/Q56E_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDESSQVLGSGKTLTIEVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS\G
GGGSGGGGS\*EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:161)

Figure 25G

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:162)

**>XENP28832 human_IL12p40(E45Q/Q56E/E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24767) - human_IL12p40_E45Q/Q56E/E59Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSQVLGSGKTLTIEVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:163)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:164)

**>XENP28833 human_IL12p40(D161N)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24768) - human_IL12p40_D161N_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGNNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:165)

Figure 25H

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:166)

**>XENP28834 human_IL12p40(E73Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24769) - human_IL12p40_E73Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGQVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:167)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:168)

**>XENP28835 human_IL12p40(Q144E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24770) - human_IL12p40_Q144E_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPEGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:169)

Figure 25I

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:170)

**>XENP28836 human_IL12p40(E262Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24771) - human_IL12p40_E262Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKRQKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:171)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:172)

**>XENP28837 human_IL12p40(E100Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24772) - human_IL12p40_E100Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKQPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:173)

Figure 25J

Chain 2 (XenD22915) - human_IL12p35_(GGGGS)2_Fc(216)_IgG1_C220S/PVA_/S267K/S364K/E357Q

*RNLPVATPDGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:174)

**>XENP28838 human_IL12p40(D18N)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24773) - human_IL12p40_D18N_(GGGGS)2-Fc(216)_IgG1_pI(-
)_Isosteric_A_C220S/PVA_/S267K/L368D/K370S

*IWELKKDVYVVELDWYPNAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:175)

Chain 2 (XenD22915) - human_IL12p35_(GGGGS)2_Fc(216)_IgG1_C220S/PVA_/S267K/S364K/E357Q

*RNLPVATPDGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:176)

**>XENP28839 human_IL12p40(E33Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24774) - human_IL12p40_E33Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEQDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:177)

Figure 25K

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:178)

**>XENP28840 human_IL12p40(Q229E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24775) - human_IL12p40_Q229E_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSREVE
VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:179)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:180)

**>XENP28841 human_IL12p40(E235Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24776) - human_IL12p40_E235Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWQYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:181)

Figure 25L

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:182)

**>XENP28842 human_IL12p40(Q256E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24777) - human_IL12p40_Q256E_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVEGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:183)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:184)

**>XENP28843 human_IL12p40(E299Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD24778) - human_IL12p40_E299Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSQWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:185)

Figure 25M

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS\GGGGSGGGGS\*EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:186)

**>XENP28844 human_IL12p40_(GGGGS)2-human_IL12p35(E153Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS\G
GGGSGGGGS\*EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:187)

Chain 2 (XenD24783) - human_IL12p35_E153Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSQT
VPQKSSLEEPDFYKTKIKLCILLHAFRIRAVTIDRVMSYLNAS\GGGGSGGGGS\*EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:188)

**>XENP28845 human_IL12p40_(GGGGS)2-human_IL12p35(E38Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS\G
GGGSGGGGS\*EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:189)

Figure 25N

Chain 2 (XenD24784) - human_IL12p35_E38Q_(GGGGS)2_Fc(216)_IgG1_C220S/PVA_/S267K/S364K/E357Q

*RNLPVATPDPGMFPCLHHSQNLLRAVSNMLQKARQTLQFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:190)

>XENP28846 human_IL12p40_(GGGGS)2-human_IL12p35(N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:191)

Chain 2 (XenD24785) - human_IL12p35_N151D_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFDSET*
*VPQKSSLEEPDFYKTKIKLCILLHAFRIRAVTIDRVMSYLNAS*\GGGGSGGGGS\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:192)

>XENP28847 human_IL12p40_(GGGGS)2-human_IL12p35(Q135E)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*\G
GGGSGGGGS\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:193)

Figure 25O

Chain 2 (XenD24786) - human_IL12p35_Q135E_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDENMLAVIDELMQALNFNSET
VPQKSSLEEPDFYKTKIKLCILLHAFRIRAVTIDRVMSYLNAS*\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:194)

**>XENP28848 human_IL12p40_(GGGGS)2-human_IL12p35(Q35D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:195)

Chain 2 (XenD24787) - human_IL12p35_Q35D_(GGGGS)2_Fc(216)_IgG1_C220S/PVA_/S267K/S364K/E357Q

*RNLPVATPDPGMFPCLHHSQNLLRAVSNMLQKARDTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:196)

**>XENP28849 human_IL12p40_(GGGGS)2-human_IL12p35(Q146E)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:197)

Figure 25P

Chain 2 (XenD24788) - human_IL12p35_Q146E_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMEALNFNSET
VPQKSSLEEPDFYKTKIKLCILLHAFRIRAVTIDRVMSYLNAS*\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:198)

**>XENP28850 human_IL12p40_(GGGGS)2-human_IL12p35(N76D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:199)

Chain 2 (XenD24789) - human_IL12p35_N76D_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLDS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO:200)

**>XENP28851 human_IL12p40_(GGGGS)2-human_IL12p35(E162Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

Chain 1 (XenD22914) - human_IL12p40_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO:201)

Figure 25Q

Chain 2 (XenD24790) - human_IL12p35_E162Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLQEPDFYKTKIKLCILLHAFRIRAVTIDRVMSYLNAS\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO:202)

**>XENP28852 human_IL12p40_(GGGGS)2-human_IL12p35(E163Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

**Chain 1 (XenD22914) - human_IL12p40_(GGGGS)2-Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS\<u>G
GGGSGGGGS</u>\EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO:203)

Chain 2 (XenD24791) - human_IL12p35_E163Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEQPDFYKTKIKLCILLHAFRIRAVTIDRVMSYLNAS\<u>GGGGSGGGGS</u>\EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO:204)

Figure 28

| XENP | IL-12p40 Variant | IL-12p35 Variant | PSTAT4 EC50 | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201-1 | WT | WT | 0.003708 | 0.005468 | | |
| 27201-2 | WT | WT | 0.003182 | 0.004785 | | |
| 28821 | D87N | WT | 0.002181 | 0.004005 | 0.63 | 0.78 |
| 28822 | Q42E | WT | 0.005075 | 0.008822 | 1.47 | 1.72 |
| 28823 | E45Q | WT | 0.005 | 0.008541 | 1.45 | 1.67 |
| 28824 | Q56E | WT | 0.006622 | 0.01139 | 1.92 | 2.22 |
| 28825 | E59Q | WT | 0.01716 | 0.02519 | 4.98 | 4.91 |
| 28826 | D62N | WT | 0.005682 | 0.008183 | 1.65 | 1.60 |
| 28827 | Q42E/E45Q | WT | 0.003749 | 0.005398 | 1.09 | 1.05 |
| 28828 | E45Q/Q56E | WT | 0.004335 | 0.006014 | 1.26 | 1.17 |
| 28829 | Q42E/E59Q | WT | 0.01448 | 0.01896 | 4.20 | 3.70 |
| 28830 | Q56E/E59Q | WT | 0.01949 | 0.02855 | 5.66 | 5.57 |
| 28831 | Q42E/E45Q/Q56E | WT | 0.01266 | 0.02008 | 3.67 | 3.92 |
| 28832 | E45Q/Q56E/E59Q | WT | 0.02254 | 0.02873 | 6.54 | 5.60 |
| 28833 | D161N | WT | 0.006258 | 0.009723 | 1.82 | 1.90 |
| 28834 | E73Q | WT | 0.005763 | 0.009079 | 1.67 | 1.77 |
| 28835 | Q144E | WT | 0.00509 | 0.008766 | 1.48 | 1.71 |
| 28836 | E262Q | WT | 0.00241 | 0.004113 | 0.70 | 0.80 |
| 28837 | E100Q | WT | 0.004449 | 0.007287 | 1.29 | 1.42 |
| 28838 | D18N | WT | 0.003218 | 0.006053 | 0.93 | 1.18 |
| 28841 | E235Q | WT | 0.01259 | 0.01474 | 3.65 | 2.88 |
| 28842 | Q256E | WT | 0.006819 | 0.009489 | 1.98 | 1.85 |
| 28843 | E299Q | WT | 0.004098 | 0.007258 | 1.19 | 1.42 |
| 28844 | WT | E153Q | 0.009734 | 0.01212 | 2.83 | 2.36 |
| 28845 | WT | E38Q | 0.003759 | 0.005643 | 1.09 | 1.10 |
| 28846 | WT | N151D | 0.009653 | 0.01517 | 2.80 | 2.96 |
| 28847 | WT | Q135E | 0.00457 | 0.006908 | 1.33 | 1.35 |
| 28848 | WT | Q35D | 0.005247 | 0.00824 | 1.52 | 1.61 |
| 28849 | WT | Q146E | 0.004868 | 0.007417 | 1.41 | 1.45 |
| 28850 | WT | N76D | 0.004796 | 0.007424 | 1.39 | 1.45 |
| 28851 | WT | E162Q | 0.005616 | 0.008755 | 1.63 | 1.71 |
| 28852 | WT | E163Q | 0.004334 | 0.007082 | 1.26 | 1.38 |

Figure 29A

>IL12p40(E59K) (SEQ ID NO:205)

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(E32Q/E59Q) (SEQ ID NO:206)

IWELKKDVYVVELDWYPDAPGEMVVLTCDTPQEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(D34N/E59Q) (SEQ ID NO:207)

IWELKKDVYVVELDWYPDAPGEMVVLTCDTPEENGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(E59Q/E187Q) (SEQ ID NO:208)

IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIQVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(S43E/E59Q) (SEQ ID NO:209)

IWELKKDVYVVELDWYPDAPGEMVVLTCDTPEEDGITWTLDQESEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

Figure 29B

>IL12p40(S43K/E59Q) (SEQ ID NO:210)

IWELKKDVYVVELDWYPDAPGEMVVLTCDTPEEDGITWTLDQKSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(E59Q/K163E) (SEQ ID NO:211)

IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNEEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(E59Q/K99E) (SEQ ID NO:212)

IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS

>IL12p40(E59Q/K258E) (SEQ ID NO:213)

IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGESKREKKDRVFTDKTSATVICRK
NASISVRAQDRYYSSSWSEWASVPCS

>IL12p40(E59Q/K260E) (SEQ ID NO:214)

IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSEREKKDRVFTDKTSATVICRK
NASISVRAQDRYYSSSWSEWASVPCS

Figure 30A

>XenD25922_human_IL12p40_E59K_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:215)

>XenD25923_human_IL12p40_E32Q/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPQEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:216)

>XenD25924_human_IL12p40_D34N/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEENGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\*GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:217)

Figure 30B

>XenD25925_human_IL12p40_E59Q/E187Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIQVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:218)

>XenD25926_human_IL12p40_S43E/E59Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQESEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:219)

>XenD25927_human_IL12p40_S43K/E59Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQKSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK* (SEQ ID NO:220)

Figure 30C

>XenD25928_human_IL12p40_E59Q/K163E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNEEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS*\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK **(SEQ ID
NO:221)**

>XenD25929_human_IL12p40_E59Q/K99E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS*\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK **(SEQ ID
NO:222)**

>XenD25930_human_IL12p40_E59Q/K258E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGESKREKKDRVFTDKTSATVICRK
NASISVRAQDRYYSSSWSEWASVPCS*\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK **(SEQ ID
NO:223)**

Figure 30D

>XenD25931 human_IL12p40_E59Q/K260E_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSEREKKDRVFTDKTSATVICRK
NASISVRAQDRYYSSSWSEWASVPCS*\GGGGSGGGGS\EPKSSDKTHTCPPCPAPPVAGPSVFLFPPKPK
DTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK (SEQ ID NO:224)

Figure 31A

>IL12p35(N151D/E153Q) (SEQ ID NO:225)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSQTVPQKSSLEEPDFYKTKIKLCILLHAFRIRAVTIDRVMSYLNAS

>IL12p35(E153K) (SEQ ID NO:226)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSKTVPQKSSLEEPDFYKTKIKLCILLHAFRIRAVTIDRVMSYLNAS

>IL12p35(N151K) (SEQ ID NO:227)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFKSETVPQKSSLEEPDFYKTKIKLCILLHAFRIRAVTIDRVMSYLNAS

>IL12p35(N151D/D165N) (SEQ ID NO:228)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQKSSLEEPNFYKTKIKLCILLHAFRIRAVTIDRVMSYLNAS

>IL12p35(Q130E/N151D) (SEQ ID NO:229)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKREIFLDQNMLAV
IDELMQALNFDSETVPQKSSLEEPDFYKTKIKLCILLHAFRIRAVTIDRVMSYLNAS

>IL12p35(N151D/K158E) (SEQ ID NO:230)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQESSLEEPDFYKTKIKLCILLHAFRIRAVTIDRVMSYLNAS

>IL12p35(E79Q/N151D) (SEQ ID NO:231)

RNLPVATPDPGMFPCLHHSQNLLRAVSNMLQKARQTLEFYPCTSEEIDHEDITKDKTSTVEACLPLELTK
NESCLNSRQTSFITNGSCLASRKTSFMMALCLSSIYEDLKMYQVEFKTMNAKLLMDPKRQIFLDQNMLAV
IDELMQALNFDSETVPQKSSLEEPDFYKTKIKLCILLHAFRIRAVTIDRVMSYLNAS

>IL12p35(D55Q/N151D) (SEQ ID NO:232)

RNLPVATPDPGMFPCLHHSQNLLRAVSNMLQKARQTLEFYPCTSEEIDHEDITKQKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQKSSLEEPDFYKTKIKLCILLHAFRIRAVTIDRVMSYLNAS

Figure 31B

>IL12p35(N136D/N151D) (SEQ ID NO:233)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQDMLAV
IDELMQALNFDSETVPQKSSLEEPDFYKTKIKLCILLHAFRIRAVTIDRVMSYLNAS

>IL12p35(N21D/N151D) (SEQ ID NO:234)

RNLPVATPDPGMFPCLHHSQDLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQKSSLEEPDFYKTKIKLCILLHAFRIRAVTIDRVMSYLNAS

>IL12p35(E143Q/N151D) (SEQ ID NO:235)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDQLMQALNFDSETVPQKSSLEEPDFYKTKIKLCILLHAFRIRAVTIDRVMSYLNAS

Figure 32A

>XenD25911
human_IL12p35_N151D/E153Q_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSQTVPQKSSLEEPDFYKTKIKLCILLHAFRIRAVTIDRVMSYLNAS\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:236)

>XenD25912
human_IL12p35_E153K_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSKTVPQKSSLEEPDFYKTKIKLCILLHAFRIRAVTIDRVMSYLNAS\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:237)

>XenD25913
human_IL12p35_N151K_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFKSETVPQKSSLEEPDFYKTKIKLCILLHAFRIRAVTIDRVMSYLNAS\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:238)

>XenD25914
human_IL12p35_N151D/D165N_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQKSSLEEPNFYKTKIKLCILLHAFRIRAVTIDRVMSYLNAS\GGGGSGGGGS\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK* (SEQ ID NO:239)

Figure 32B

>XenD25915
human_IL12p35_Q130E/N151D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKREIFLDQNMLAV
IDELMQALNFDSETVPQKSSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:240)

>XenD25916
human_IL12p35_N151D/K158E_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQESSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:241)

>XenD25917
human_IL12p35_E79Q/N151D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK
NESCLNSRQTSFITNGSCLASRKTSFMMALCLSSIYEDLKMYQVEFKTMNAKLLMDPKRQIFLDQNMLAV
IDELMQALNFDSETVPQKSSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:242)

>XenD25918
human_IL12p35_D55Q/N151D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKQKTSTVEACLPLELTK
NESCLNSRETSFITNGSCLASRKTSFMMALCLSSIYEDLKMYQVEFKTMNAKLLMDPKRQIFLDQNMLAV
IDELMQALNFDSETVPQKSSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:243)

Figure 32C

>XenD25919 human_IL12p35_N136D/N151D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK*
*NESCLNSRETSFITNGSCLASRKTSFMMALCLSSIYEDLKMYQVEFKTMNAKLLMDPKRQIFLDQDMLAV*
*IDELMQALNFDSETVPQKSSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:244)

>XenD25920 human_IL12p35_N21D/N151D_(GGGGS)2_Fc(216)_IgG1_C220S/PVA_/S267K/S364K/E357Q_pTT5

*RNLPVATPDPGMFPCLHHSQDLLRAVSNMLQKARQTLEFYPCTSEEIDHEDITKDKTSTVEACLPLELTK*
*NESCLNSRETSFITNGSCLASRKTSFMMALCLSSIYEDLKMYQVEFKTMNAKLLMDPKRQIFLDQNMLAV*
*IDELMQALNFDSETVPQKSSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:245)

>XenD25921 human_IL12p35_E143Q/N151D_(GGGGS)2_Fc(216)_IgG1_C220S/PVA_/S267K/S364K/E357Q_pTT5

*RNLPVATPDPGMFPCLHHSQNLLRAVSNMLQKARQTLEFYPCTSEEIDHEDITKDKTSTVEACLPLELTK*
*NESCLNSRETSFITNGSCLASRKTSFMMALCLSSIYEDLKMYQVEFKTMNAKLLMDPKRQIFLDQNMLAV*
*IDQLMQALNFDSETVPQKSSLEEPDFYKTKIKLCILLHAFRIRAVTIDRVMSYLNAS*\<u>GGGGSGGGGS</u>\E
PKSSDKTHTCPPCPAPPVAGPSVFLFPPKPKDTLMISRTPEVTCVVVDVKHEDPEVKFNWYVDGVEVHNA
KTKPREEQYNSTYRVVSVLTVLHQDWLNGKEYKCKVSNKALPAPIEKTISKAKGQPREPQVYTLPPSREQ
MTKNQVKLTCLVKGFYPSDIAVEWESNGQPENNYKTTPPVLDSDGSFFLYSKLTVDKSRWQQGNVFSCSV
MHEALHNHYTQKSLSLSPGK (SEQ ID NO:246)

Figure 33A

>XENP29949 human_IL12p40(E59Q)_(GGGGS)2-human_IL12p35(N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24760) - human_IL12p40(E59Q)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 93)

Chain 2 (XenD24785) - human_IL12p35(N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 132)

>XENP29950 human_IL12p40(Q56E/E59Q)_(GGGGS)2-human_IL12p35(N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24765) - human_IL12p40(Q56E/E59Q)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIEVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 98)

Figure 33B

Chain 2 (XenD24785) - human_IL12p35(N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 132)

**>XENP29951 human_IL12p40(E59K)_(GGGGS)2-human_IL12p35(N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

**Chain 1 (XenD25922) - human_IL12p40(E59K)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 215)

Chain 2 (XenD24785) - human_IL12p35(N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 132)

Figure 33C

>XENP29952 human_IL12p40(E59K)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD25922) - human_IL12p40(E59K)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS*/EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 215)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 433)

>XENP29953 human_IL12p40(E32Q/E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD25923) - human_IL12p40(E32Q/E59Q)_(GGGGS)2_Fc(216)_IgG1_pI(-
)_Isosteric_A_C220S/PVA_/S267K/L368D/K370S

*IWELKKDVYVVELDWYPDAPGEMVVLTCDTPQEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS*/EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 216)

Figure 33D

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 434)

**>XENP29954 human_IL12p40(D34N/E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

**Chain 1 (XenD25924) - human_IL12p40(D34N/E59Q)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEENGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 217)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 435)

Figure 33E

>XENP29955 human_IL12p40(E59Q/E187Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD25925) - human_IL12p40(E59Q/E187Q)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIQVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G̲
G̲G̲G̲S̲G̲G̲G̲G̲S̲/EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 218)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/G̲G̲G̲G̲S̲G̲G̲G̲G̲S̲/EPKSSDKTHTCPPCPAPPVAGP
SVFLFPPKPKDTLMISRTPEVTCVVVDKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 436)

>XENP29956 human_IL12p40(S43E/E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD25926) - human_IL12p40(S43E/E59Q)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQESEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G̲
G̲G̲G̲S̲G̲G̲G̲G̲S̲/EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 219)

Figure 33F

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 437)

>XENP29957 human_IL12p40(S43K/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD25927) - human_IL12p40(S43K/E59Q)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQKSEVLGSGKTLTIQVKQFGDAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*/<u>G</u>
<u>GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 220)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 438)

Figure 33G

>XENP29958 human_IL12p40(E59Q/K163E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD25928) - human_IL12p40(E59Q/K163E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNEEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 221)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 439)

>XENP29959 human_IL12p40(E59Q/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD25929) - human_IL12p40(E59Q/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 222)

Figure 33H

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 440)

><u>XENP29960 human_IL12p40(E59Q/K258E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q</u>

**Chain 1 (XenD25930) - human_IL12p40(E59Q/K258E)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGESKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 223)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 441)

Figure 33I

>XENP29961 human_IL12p40(E59Q/K260E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD25931) - human_IL12p40(E59Q/K260E)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSEREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 224)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 442)

>XENP29962 human_IL12p40_(GGGGS)2-human_IL12p35(N151D/E153Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Figure 33J

Chain 2 (XenD25911) - human_IL12p35(N151D/E153Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFDSQT*
*VPQKSSLEEPDFYKTKIKLCILLHAFRIRAVTIDRVMSYLNAS/*<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 236)

>XENP29963 human_IL12p40_(GGGGS)2-human_IL12p35(E153K)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS/*<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 47)

Chain 2 (XenD25912) - human_IL12p35(E153K)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSKT*
*VPQKSSLEEPDFYKTKIKLCILLHAFRIRAVTIDRVMSYLNAS/*<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 237)

Figure 33K

>XENP29964 human_IL12p40_(GGGGS)2-human_IL12p35(N151K)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Chain 2 (XenD25913) - human_IL12p35(N151K)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFKSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 238)

>XENP29965 human_IL12p40_(GGGGS)2-human_IL12p35(N151D/D165N)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Figure 33L

Chain 2 (XenD25914) - human_IL12p35(N151D/D165N)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPNFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 239)

>XENP29966 human_IL12p40_(GGGGS)2-human_IL12p35(Q130E/N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 47)

Chain 2 (XenD25915) - human_IL12p35(Q130E/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKREIFLDQNMLAVIDELMQALNFDSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 240)

Figure 33M

>XENP29967 human_IL12p40_(GGGGS)2-human_IL12p35(N151D/K158E)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Chain 2 (XenD25916) -
human_IL12p35(N151D/K158E)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQESSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 241)

>XENP29968 human_IL12p40_(GGGGS)2-human_IL12p35(E79Q/N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Figure 33N

Chain 2 (XenD25917) - human_IL12p35(E79Q/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RQTSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 242)

<u>>XENP29969 human_IL12p40_(GGGGS)2-human_IL12p35(D55Q/N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q</u>

**Chain 1 (XenD22914) - human_IL12p40_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 47)

Chain 2 (XenD25918) - human_IL12p35(D55Q/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 243)

Figure 33O

>XENP29970 human_IL12p40_(GGGGS)2-human_IL12p35(N136D/N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Chain 2 (XenD25919) -
human_IL12p35(N136D/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQDMLAVIDELMQALNFDSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 244)

>XENP29971 human_IL12p40_(GGGGS)2-human_IL12p35(N21D/N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Figure 33P

Chain 2 (XenD25920) - human_IL12p35(N21D/N151D)_(GGGGS)2_Fc(216)_IgG1_C220S/PVA_/S267K/S364K/E357Q

*RNLPVATPDPGMFPCLHHSQDLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFDSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 245)

<u>>XENP29972 human_IL12p40_(GGGGS)2-human_IL12p35(E143Q/N151D)_(GGGGS)2-Fc(216)_IgG1_pI(-
)_Isosteric_A_C220S/PVA_/S267K/L368D/K370S_Fc(216)_IgG1_C220S/PVA_/S364K/E357Q</u>

**Chain 1 (XenD22914) - human_IL12p40_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 47)

Chain 2 (XenD25921) - human_IL12p35(E143Q/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDQLMQALNFDSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 246)

Figure 36

| XENP | IL-12p40 Variant | IL-12p35 Variant | PSTAT4 EC50 | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201 | WT | WT | 0.08704 | 0.1286 | | |
| 28825 | E59Q | WT | 0.1737 | 0.2259 | 2.00 | 1.76 |
| 28830 | Q56E/E59Q | WT | 0.3278 | 0.41 | 3.77 | 3.19 |
| 28846 | WT | N151D | 0.05648 | 0.08265 | 0.65 | 0.64 |
| 29949 | E59Q | N151D | 0.2748 | 0.3765 | 3.16 | 2.93 |
| 29950 | Q56E/E59Q | N151D | 0.2794 | 0.3592 | 3.21 | 2.79 |
| 29951 | E59K | N151D | 0.9019 | 1.195 | 10.36 | 9.29 |
| 29952 | E59K | WT | 1.012 | 1.547 | 11.63 | 12.03 |
| 29953 | E32Q/E59Q | WT | 0.3248 | 0.4581 | 3.73 | 3.56 |
| 29954 | D34N/E59Q | WT | 0.4004 | 0.5114 | 4.60 | 3.98 |
| 29955 | E59Q/E187Q | WT | 0.2823 | 0.3446 | 3.24 | 2.68 |
| 29956 | S43E/E59Q | WT | 0.2149 | 0.2776 | 2.47 | 2.16 |
| 29957 | S43K/E59Q | WT | N/A | N/A | N/A | N/A |
| 29958 | E59Q/K163E | WT | 0.2182 | 0.2643 | 2.51 | 2.06 |
| 29959 | E59Q/K99E | WT | 0.4892 | 0.6045 | 5.62 | 4.70 |
| 29960 | E59Q/K258E | WT | 0.2553 | 0.2885 | 2.93 | 2.24 |
| 29961 | E59Q/K260E | WT | 0.3782 | 0.4094 | 4.35 | 3.18 |
| 29962 | WT | N151D/E153Q | 0.09898 | 0.128 | 1.14 | 1.00 |
| 29963 | WT | E153K | 0.1044 | 0.1458 | 1.20 | 1.13 |
| 29964 | WT | N151K | 0.07835 | 0.1011 | 0.90 | 0.79 |
| 29965 | WT | N151D/D165N | 0.08989 | 0.118 | 1.03 | 0.92 |
| 29966 | WT | Q130E/N151D | 0.06791 | 0.1092 | 0.78 | 0.85 |
| 29967 | WT | N151D/K158E | 0.1255 | 0.1984 | 1.44 | 1.54 |
| 29968 | WT | E79Q/N151D | 0.1367 | 0.1862 | 1.57 | 1.45 |
| 29969 | WT | D55Q/N151D | 0.1769 | 0.2245 | 2.03 | 1.75 |
| 29970 | WT | N136D/N151D | 0.145 | 0.188 | 1.67 | 1.46 |
| 29971 | WT | N21D/N151D | 0.1043 | 0.1561 | 1.20 | 1.21 |
| 29972 | WT | E143Q/N151D | 0.1426 | 0.1919 | 1.64 | 1.49 |

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 325)

>IL12p40(D34N/E59K)

IWELKKDVYVVELDWYPDAPGEMVVLTCDTPEENGITWTLDQSSEVLGSGKTLTIQVKKFGDAGQYTCHK
GGEVLSHSLLLLHKKEDGIWSTDILKDQKEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 326)

>IL12p40(D34N/E59K/K99E)

IWELKKDVYVVELDWYPDAPGEMVVLTCDTPEENGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 327)

>IL12p40(D34K/E59K/K99E)

IWELKKDVYVVELDWYPDAPGEMVVLTCDTPEEKGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 328)

>IL12p40(E32Q/D34N/E59K/K99E)

IWELKKDVYVVELDWYPDAPGEMVVLTCDTPQENGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 329)

IWELKKDVYVVELDWYPDAPGEMVVLTCDTPQEKGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 330)

>IL12p40(E32K/D34N/E59K/K99E)

IWELKKDVYVVELDWYPDAPGEMVVLTCDTPKENGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 331)

>IL12p40(E32K/D34K/E59K/K99E)

IWELKKDVYVVELDWYPDAPGEMVVLTCDTPKEKGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 332)

RNLPVATPDPGMFPCLHHSQNLLRAVSNMLQKARQTLEFYPCTSEEIDHEDITKQKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS (SEQ ID NO: 333)

>IL12p35(D55K)

RNLPVATPDPGMFPCLHHSQNLLRAVSNMLQKARQTLEFYPCTSEEIDHEDITKKKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS (SEQ ID NO: 334)

Figure 39A

>XENP30597 human_IL12p40_E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD26411) - human_IL12p40_E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 291)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 443)

>XENP30598 human_IL12p40_D34N/E59K_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD26412) - human_IL12p40_D34N/E59K_(GGGGS)2_Fc(216)_IgG1_pI(-)_Isosteric_A_C220S/PVA_/S267K/L368D/K370S

*IWELKKDVYVVELDWYPDAPGEMVVLTCDTPEENGITWTLDQSSEVLGSGKTLTIQVKKFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 292)

Figure 39B

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 444)

>XENP30599 human_IL12p40_D34N/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD26413) - human_IL12p40_D34N/E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPEENGITWTLDQSSEVLGSGKTLTIQVKKFGDAGQYTCHKGGEVLSH*
*SLLLLHKKEDGIWSTDILKDQEEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 293)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 445)

Figure 39C

>XENP30600 human_IL12p40_D34K/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD26414) - human_IL12p40_D34K/E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEKGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 294)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 446)

>XENP30601 human_IL12p40_E32Q/D34N/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD26415) - human_IL12p40_E32Q/D34N/E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPQENGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 295)

Figure 39D

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS/*<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 447)

>XENP30602 human_IL12p40_E32Q/D34K/E59K/K99E_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

Chain 1 (XenD26416) - human_IL12p40_E32Q/D34K/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPQEKGITWTLDQSSEVLGSGKTLTIQVKKFGDAGQYTCHKGGEVLSH*
*SLLLLHKKEDGIWSTDILKDQEEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS/*<u>G</u>
<u>GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 296)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS/*<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 448)

Figure 39E

>XENP30603 human_IL12p40_E32K/D34N/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26417) - human_IL12p40_E32K/D34N/E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPKENGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 297)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 449)

>XENP30604 human_IL12p40_E32K/D34K/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26418) - human_IL12p40_E32K/D34K/E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPKEKGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 298)

Figure 39F

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 450)

<u>>XENP30605 human_IL12p40_E32Q/D34N/E59K/K99E_(GGGGS)2-human_IL12p35_D55Q_(GGGGS)2-</u>
<u>Fc(216)_IgG1_pI(-</u>
<u>)_Isosteric_A_C220S/PVA_/S267K/L368D/K370S_Fc(216)_IgG1_C220S/PVA_/S267K/S364K/E357Q</u>

Chain 1 (XenD26415) - human_IL12p40_E32Q/D34N/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPQENGITWTLDQSSEVLGSGKTLTIQVKKFGDAGQYTCHKGGEVLSH*
*SLLLLHKKEDGIWSTDILKDQEEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*/<u>G</u>
<u>GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 295)

Chain 2 (XenD26427) - human_IL12p35_D55Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 299)

Figure 39G

>XENP30606 human_IL12p40_E32Q/D34K/E59K/K99E_(GGGGS)2-human_IL12p35_D55Q_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26416) - human_IL12p40_E32Q/D34K/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPQEKGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 296)

Chain 2 (XenD26427) - human_IL12p35_D55Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 299)

>XENP30607 human_IL12p40_E32K/D34N/E59K/K99E_(GGGGS)2-human_IL12p35_D55Q_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26417) - human_IL12p40_E32K/D34N/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPKENGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 297)

Figure 39H

Chain 2 (XenD26427) - human_IL12p35_D55Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 299)

<u>>XENP30608 human_IL12p40_E32K/D34K/E59K/K99E_(GGGGS)2-human_IL12p35_D55Q_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q</u>

**Chain 1 (XenD26418) - human_IL12p40_E32K/D34K/E59K/K99E_(GGGGS)2_Fc(216)_IgG1_pI(-
)_Isosteric_A_C220S/PVA_/S267K/L368D/K370S**

*IWELKKDVYVVELDWYPDAPGEMVVLTCDTPKEKGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 298)

Chain 2 (XenD26427) - human_IL12p35_D55Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 299)

Figure 39I

>XENP30609 human_IL12p40_E32K/D34K/E59K/K99E_(GGGGS)2-human_IL12p35_D55K_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26418) - human_IL12p40_E32K/D34K/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPKEKGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 298)

Chain 2 (XenD26428) - human_IL12p35_D55K_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKKKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 300)

Figure 41

| XENP | IL-12p40 Variant | IL-12p35 Variant | PSTAT4 EC50 | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201 | WT | WT | 0.1101 | 0.2097 | | |
| 29952 | E59K | WT | 1.056 | 1.287 | 9.59 | 6.14 |
| 30597 | E59K/K99E | WT | 5.507 | 9.768 | 50.02 | 46.58 |
| 30598 | D34N/E59K | WT | 1.308 | 1.806 | 11.88 | 8.61 |
| 30599 | D34N/E59K/K99E | WT | 3.23 | 4.839 | 29.34 | 23.08 |
| 30600 | D34K/E59K/K99E | WT | 5.929 | 9.898 | 53.85 | 47.20 |
| 30601 | E32Q/D34N/E59K/K99E | WT | 6.804 | 11.71 | 61.80 | 55.84 |
| 30602 | E32Q/D34K/E59K/K99E | WT | 2.714 | 3.645 | 24.65 | 17.38 |
| 30603 | E32K/D34N/E59K/K99E | WT | 1.13 | 1.482 | 10.26 | 7.07 |
| 30604 | E32K/D34K/E59K/K99E | WT | 8.44 | 12.98 | 76.66 | 61.90 |
| 30607 | E32K/D34N/E59K/K99E | D55Q | 12.1 | 24.31 | 109.90 | 115.93 |
| 30608 | E32K/D34K/E59K/K99E | D55Q | 10.25 | 25.27 | 93.10 | 120.51 |
| 30609 | E32K/D34K/E59K/K99E | D55K | 5.426 | 8.258 | 49.28 | 39.38 |

IWELKKDVYVVELDWYPDAPGEMVVLTCDTPEEDGITWTLDQSSEVLGSGKTLTIQVKYFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 335)

>IL12p40(E59K/K99Y)

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQYEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 336)

>IL12p40(E59Y/K99Y)

IWELKKDVYVVELDWYPDAPGEMVVLTCDTPEEDGITWTLDQSSEVLGSGKTLTIQVKYFGDAGQYTCHK
GGEVLSHSLLLLHKKEDGIWSTDILKDQYEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 337)

>IL12p40(E45K/E59K/K99E)

IWELKKDVYVVELDWYPDAPGEMVVLTCDTPEEDGITWTLDQSSKVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 338)

>IL12p40(D18K/E59K/K99E)

IWELKKDVYVVELDWYPKAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 339)

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPEGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 340)

>IL12p40(E59K/K99E/Q144K)

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPKGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 341)

>IL12p40(E59K/K99E/R159E)

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVEGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKKDRVFTDKTSATVICRK
NASISVRAQDRYYSSSWSEWASVPCS (SEQ ID NO: 342)

>IL12p40(E59K/K99E/K264E)

IWELKKDVYVVELDWYPDAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKEDRVFTDKTSATVICRK
NASISVRAQDRYYSSSWSEWASVPCS (SEQ ID NO: 343)

>IL12p40(D18K/E59K/K99E/K264E)

IWELKKDVYVVELDWYPKAPGEMVVLTCDTPEEDGITWTLDQSSEVLGSGKTLTIQVKKFGDAGQYTCHK
GGEVLSHSLLLLHKKEDGIWSTDILKDQEEPKNKTFLRCEAKNYSGRFTCWWLTTISTDLTFSVKSSRGS
SDPQGVTCGAATLSAERVRGDNKEYEYSVECQEDSACPAAEESLPIEVMVDAVHKLKYENYTSSFFIRDI
IKPDPPKNLQLKPLKNSRQVEVSWEYPDTWSTPHSYFSLTFCVQVQGKSKREKEDRVFTDKTSATVICRK
NASISVRAQDRYYSSSWSEWASVPCS (SEQ ID NO: 344)

RNLPVATPDPGMFPCLHHSQNLLRAVSNMLQKARQTLEFYPCTSEEIDHEDITKDKTSTVEACLPLELTK
NESCLNSRETSFITNGSCLASRKTSAMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS (SEQ ID NO: 345)

>IL12p35(M97A)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFAMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS (SEQ ID NO: 346)

>IL12p35(L89A)

RNLPVATPDPGMFPCLHHSQNLLRAVSNMLQKARQTLEFYPCTSEEIDHEDITKDKTSTVEACLPLELTK
NESCLNSRETSFITNGSCAASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS (SEQ ID NO: 347)

>IL12p35(L124A)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLAMDPKRQIFLDQNMLAV
IDELMQALNFNSETVPQKSSLEEPDFYKTKIKLCILLHAFRIRAVTIDRVMSYLNAS (SEQ ID NO: 348)

>IL12p35(M125A)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLADPKRQIFLDQNMLAV
IDELMQALNFNSETVPQKSSLEEPDFYKTKIKLCILLHAFRIRAVTIDRVMSYLNAS (SEQ ID NO: 349)

>IL12p35(L75A)

RNLPVATPDPGMFPCLHHSQNLLRAVSNMLQKARQTLEFYPCTSEEIDHEDITKDKTSTVEACLPLELTK
NESCANSRETSFITNGSCLASRKTSFMMALCLSSIYEDLKMYQVEFKTMNAKLLMDPKRQIFLDQNMLAV
IDELMQALNFNSETVPQKSSLEEPDFYKTKIKLCILLHAFRIRAVTIDRVMSYLNAS (SEQ ID NO: 350)

>IL12p35(I171A)

RNLPVATPDPGMFPCLHHSQNLLRAVSNMLQKARQTLEFYPCTSEEIDHEDITKDKTSTVEACLPLELTK
NESCLNSRETSFITNGSCLASRKTSFMMALCLSSIYEDLKMYQVEFKTMNAKLLMDPKRQIFLDQNMLAV
IDELMQALNFNSETVPQKSSLEEPDFYKTKAKLCILLHAFRIRAVTIDRVMSYLNAS (SEQ ID NO: 351)

Figure 44A

>XENP31250 human_IL12p40(E59Y/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27070) - human_IL12p40(E59Y/K99E)_(GGGGS)2_Fc(216)_IgG1_pI(-)_Isosteric_A_C220S/PVA_/S267K/L368D/K370S
*IWELKKDVYVVELDWYPDAPGEMVVLTCDTPEEDGITWTLDQSSEVLGSGKTLTIQVKYFGDAGQYTCHKGGEVLSHSLLLLHKKED
GIWSTDILKDQEEPKNKTFLRCEAKNYSGRFTCWWLTTISTDLTFSVKSSRGSSDPQGVTCGAATLSAERVRGDNKEYEYSVECQEDS
ACPAAEESLPIEVMVDAVHKLKYENYTSSFFIRDIIKPDPPKNLQLKPLKNSRQVEVSWEYPDTWSTPHSYFSLTFCVQVQGKSKREKK
DRVFTDKTSATVICRKNASISVRAQDRYYSSSWSEWASVPCS/*<ins>GGGGSGGGGS</ins>/EPKSSDKTHTCPPCPAPPVAGPSVFLFPPKPKDT
LMISRTPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 301)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNSRETSFITNGSCL
ASRKTSFMMALCLSSIYEDLKMYQVEFKTMNAKLLMDPKRQIFLDQNMLAVIDELMQALNFNSETVPQKSSLEEPDFYKTKIKLCILL
HAFRIRAVTIDRVMSYLNAS/*<ins>GGGGSGGGGS</ins>/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYTLPPSREQM
TKNQVKLTCLVKGFYPSDIAVEWESNGQPENNYKTTPPVLDSDGSFFLYSKLTVDKSRWQQGNVFSCSVMHEALHNHYTQKSLSLS
PGK (SEQ ID NO: 451)

>XENP31251 human_IL12p40(E59K/K99Y)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27071) - human_IL12p40(E59K/K99Y)_(GGGGS)2_Fc(216)_IgG1_pI(-)_Isosteric_A_C220S/PVA_/S267K/L368D/K370S
*IWELKKDVYVVELDWYPDAPGEMVVLTCDTPEEDGITWTLDQSSEVLGSGKTLTIQVKKFGDAGQYTCHKGGEVLSHSLLLLHKKED
GIWSTDILKDQYEPKNKTFLRCEAKNYSGRFTCWWLTTISTDLTFSVKSSRGSSDPQGVTCGAATLSAERVRGDNKEYEYSVECQEDS
ACPAAEESLPIEVMVDAVHKLKYENYTSSFFIRDIIKPDPPKNLQLKPLKNSRQVEVSWEYPDTWSTPHSYFSLTFCVQVQGKSKREKK
DRVFTDKTSATVICRKNASISVRAQDRYYSSSWSEWASVPCS/*<ins>GGGGSGGGGS</ins>/EPKSSDKTHTCPPCPAPPVAGPSVFLFPPKPKDT
LMISRTPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 302)
Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNSRETSFITNGSCL
ASRKTSFMMALCLSSIYEDLKMYQVEFKTMNAKLLMDPKRQIFLDQNMLAVIDELMQALNFNSETVPQKSSLEEPDFYKTKIKLCILL
HAFRIRAVTIDRVMSYLNAS/*<ins>GGGGSGGGGS</ins>/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYTLPPSREQM
TKNQVKLTCLVKGFYPSDIAVEWESNGQPENNYKTTPPVLDSDGSFFLYSKLTVDKSRWQQGNVFSCSVMHEALHNHYTQKSLSLS
PGK (SEQ ID NO: 452)

Figure 44B

>XENP31252 human_IL12p40(E59Y/K99Y)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD27072) - human_IL12p40(E59Y/K99Y)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKYFGDAGQYTCHKGGEVLSH
SLLLLHKKEDGIWSTDILKDQYEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/*EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 303)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/*GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 453)

>XENP31253 human_IL12p40(E45K/E59K/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD27073) - human_IL12p40(E45K/E59K/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSKVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/*EPKSSDKTHTCPPCPAPPVAGPSVFLFPPKPKDTLMISRTPEVTCVVVDKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 304)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/*GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 454)

Figure 44C

>XENP31254 human_IL12p40(D18K/E59K/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD27074) - human_IL12p40(D18K/E59K/K99E)_(GGGGS)2_Fc(216)_IgG1_pI(-)_Isosteric_A_C220S/PVA_/S267K/L368D/K370S

*IWELKKDVYVVELDWYPKAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 305)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 455)

>XENP31255 human_IL12p40(E59K/K99E/Q144E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD27075) - human_IL12p40(E59K/K99E/Q144E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPEGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 306)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 456)

Figure 44D

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 457)

Figure 44E

>XENP31256 human_IL12p40(E59K/K99E/Q144K)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD27076) - human_IL12p40(E59K/K99E/Q144K)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPKGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 307)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 458)

>XENP31257 human_IL12p40(E59K/K99E/R159E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD27077) - human_IL12p40(E59K/K99E/R159E)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVEGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 308)

Figure 44F

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<ins>GGGGSGGGGS</ins>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 459)

>XENP31258 human_IL12p40(E59K/K99E/K264E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD27078) - human_IL12p40(E59K/K99E/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKEDRVFTDKTSATVICRKNASISVRAQDRYYSSSWSEWASVPCS/<ins>G
GGGSGGGGS</ins>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 309)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<ins>GGGGSGGGGS</ins>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 460)

Figure 44G

>XENP31259 human_IL12p40(E59K/K99E)_(GGGGS)2-human_IL12p35(F96A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 291)

Chain 2 (XenD27088) - human_IL12p35(F96A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSAMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 310)

>XENP31260 human_IL12p40(E59K/K99E)_(GGGGS)2-human_IL12p35(M97A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 291)

Figure 44H

Chain 2 (XenD27089) - human_IL12p35(M97A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFAMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 311)

>XENP31261 human_IL12p40(E59K/K99E)_(GGGGS)2-human_IL12p35(L89A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD26411) - human_IL12p40(E59K/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH*
*SLLLLHKKEDGIWSTDILKDQEEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 291)

Chain 2 (XenD27090) - human_IL12p35(L89A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCAASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 312)

Figure 44I

>XENP31262 human_IL12p40(E59K/K99E)_(GGGGS)2-human_IL12p35(L124A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 291)

Chain 2 (XenD27091) - human_IL12p35(L124A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLAMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 313)

>XENP31263 human_IL12p40(E59K/K99E)_(GGGGS)2-human_IL12p35(M125A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 291)

Figure 44J

Chain 2 (XenD27092) - human_IL12p35(M125A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLADPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 314)

**>XENP31264 human_IL12p40(E59K/K99E)_(GGGGS)2-human_IL12p35(L75A)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q**

**Chain 1 (XenD26411) - human_IL12p40(E59K/K99E)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 291)

Chain 2 (XenD27093) - human_IL12p35(L57A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCANS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 315)

Figure 44K

>XENP31265 human_IL12p40(E59K/K99E)_(GGGGS)2-human_IL12p35(I171A)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 291)

Chain 2 (XenD27094) - human_IL12p35(I171A)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKAKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 316)

>XENP32186_human_IL12p40(D18K/E59K/K99E/K264E)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD28173) - human_IL12p40(D18K/E59K/K99E/K264E)_(GGGGS)2_Fc(216)_IgG1_pI(-
)_Isosteric_A_C220S/PVA_/S267K/L368D/K370S
*IWELKKDVYVVELDWYPKAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKEDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 317)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 461)

Figure 45A

>XENP31142 human_IL12p40_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 (XenD24876) - human_IL12p40_(GGGGS)2_Fc(216)_IgG1_pI(-)_Isosteric_A_C220S/PVA_/S267K/L368D/K370S/M428L/N434S

*IWELKKDVYVVELDWYPDAPGEMVVLTCDTPEEDGITWTLDQSSEVLGSGKTLTIQVKEFGDAGQYTCHKGGEVLSH*
*SLLLLHKKEDGIWSTDILKDQKEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS/G*
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVLHEALHSHYT
QKSLSLSPGK (SEQ ID NO: 318)

Chain 2 (XenD24877) - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS/*GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK (SEQ ID NO: 319)

>XENP31143 human_IL12p40_E32Q/D34N/E59K/K99E_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 (XenD27162) - human_IL12p40_E32Q/D34N/E59K/K99E_(GGGGS)2_Fc(216)_IgG1_pI(-)_Isosteric_A_C220S/PVA_/S267K/L368D/K370S/M428L/N434S

*IWELKKDVYVVELDWYPDAPGEMVVLTCDTPQENGITWTLDQSSEVLGSGKTLTIQVKKFGDAGQYTCHKGGEVLSH*
*SLLLLHKKEDGIWSTDILKDQEEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFCVQVQGKSKREKKDRVFTDKTSATVICRKNASISVRAQDRYYSSSWSEWASVPCS/G*
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVLHEALHSHYT
QKSLSLSPGK (SEQ ID NO: 320)

Chain 2 (XenD24877) - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS/*GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK (SEQ ID NO: 319)

Figure 45B

>XENP31144 human_IL12p40_E32K/D34N/E59K/K99E_(GGGGS)2-human_IL12p35_D55Q_(GGGGS)2-
Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 (XenD27163) - human_IL12p40_E32K/D34N/E59K/K99E_(GGGGS)2_Fc(216)_IgG1_pI(-
)_Isosteric_A_C220S/PVA_/S267K/L368D/K370S/M428L/N434S

*IWELKKDVYVVELDWYPDAPGEMVVLTCDTPKENGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVLHEALHSHYT
QKSLSLSPGK* (SEQ ID NO: 321)

Chain 2 (XenD27166) - human_IL12p35_D55Q_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKQKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK* (SEQ ID NO: 322)

>XENP31145 human_IL12p40_E32K/D34K/E59K/K99E_(GGGGS)2-human_IL12p35_D55Q_(GGGGS)2-
Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 (XenD27164) - human_IL12p40_E32K/D34K/E59K/K99E_(GGGGS)2_Fc(216)_IgG1_pI(-
)_Isosteric_A_C220S/PVA_/S267K/L368D/K370S/M428L/N434S

*IWELKKDVYVVELDWYPDAPGEMVVLTCDTPKEKGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVLHEALHSHYT
QKSLSLSPGK* (SEQ ID NO: 323)

Chain 2 (XenD27166) - human_IL12p35_D55Q_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKQKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK* (SEQ ID NO: 322)

Figure 45C

>XENP31146 human_IL12p40_E59K/K99E_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 (XenD27165) - human_IL12p40_E59K/K99E_(GGGGS)2_Fc(216)_IgG1_pI(-)_Isosteric_A_C220S/PVA_/S267K/L368D/K370S/M428L/N434S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFCVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVLHEALHSHYT
QKSLSLSPGK* (SEQ ID NO: 324)

Chain 2 (XenD24877) - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK* (SEQ ID NO: 319)

Figure 47

| | | | pSTAT4 EC50 (µg/ml) | | FOLD DECREASE IN EC50 | |
|---|---|---|---|---|---|---|
| XENP | IL-12p40 Variant | IL-12p30 Variant | CD4+ CD45RA+ CD25+ | CD8+ CD45RA+ CD25+ | CD4+ CD45RA+ CD25+ | CD8+ CD45RA+ CD25+ |
| 27201 | WT | WT | 0.2535 | 0.3516 | | |
| 31250 | E59Y/K99E | WT | 4.767 | 6.049 | 18.80 | 17.20 |
| 31251 | E59K/K99Y | WT | 2.383 | 2.751 | 9.40 | 7.82 |
| 31252 | E59Y/K99Y | WT | 0.8014 | 1.037 | 3.16 | 2.95 |
| 31253 | E45K/E59K/K99E | WT | 8.04 | 7.157 | 31.72 | 20.36 |
| 31254 | D18K/E59K/K99E | WT | 17.75 | 21.89 | 70.02 | 62.26 |
| 31255 | E59K/K99E/Q144E | WT | 4.581 | 5.638 | 18.07 | 16.04 |
| 31256 | E59K/K99E/Q144K | WT | 4.713 | 6.344 | 18.59 | 18.04 |
| 31257 | E59K/K99E/R159E | WT | 5.084 | 6.481 | 20.06 | 18.43 |
| 31258 | E59K/K99E/K264E | WT | 24.15 | 20.38 | 95.27 | 57.96 |
| 31259 | E59K/K99E | F96A | 5.822 | 6.153 | 22.97 | 17.50 |
| 31260 | E59K/K99E | M97A | 4.431 | 4.729 | 17.48 | 13.45 |
| 31261 | E59K/K99E | L89A | 4.067 | 5.22 | 16.04 | 14.85 |
| 31262 | E59K/K99E | L124A | 3.102 | 4.657 | 12.24 | 13.25 |
| 31263 | E59K/K99E | M125A | 11.99 | 11.7 | 47.30 | 33.28 |
| 31264 | E59K/K99E | L75A | 4.112 | 4.49 | 16.22 | 12.77 |
| 31265 | E59K/K99E | I171A | 2.897 | 3.565 | 11.43 | 10.14 |

A)

(scIL-12(p40/p35))₂-Fc

Example: XENP31289

B)

(scIL-12(p35/p40))₂-Fc

C)

Fc-(scIL-12(p40/p35))₂

D)

Fc-(scIL-12(p35/p40))₂

Figure 49

>XENP31289 human_IL12p40_(GGGGS)5-human_IL12p35_(GGGGS)2_Fc(216)_IgG1_pI(-)_Isosteric_A_C220S/PVA_/S267K/L368D/K370S

IWELKKDVYVVELDWYPDAPGEMVVLTCDTPEEDGITWTLDQSSEVLGSGKTLTIQVKEFGDAGQYTCHKGGEVLSHS
LLLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS/<u>GGGGSGGGGS
GGGGSGGGGSGGGGS</u>/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVID
ELMQALNFNSETVPQKSSLEEPDFYKTKIKLCILLHAFRIRAVTIDRVMSYLNAS/<u>GGGGSGGGGS</u>/EPKSSDKTHTCPPC
PAPPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 51)

>XENP31291 human_IL12p40(E59K/K99E)_(GGGGS)5-human_IL12p35_(GGGGS)2_Fc(216)_IgG1_pI(-)_Isosteric_A_C220S/PVA_/S267K/L368D/K370S

IWELKKDVYVVELDWYPDAPGEMVVLTCDTPEEDGITWTLDQSSEVLGSGKTLTIQVKKFGDAGQYTCHKGGEVLSHS
LLLLHKKEDGIWSTDILKDQEEPKNKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS/<u>GGGGSGGGGS
GGGGSGGGGSGGGGS</u>/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVID
ELMQALNFNSETVPQKSSLEEPDFYKTKIKLCILLHAFRIRAVTIDRVMSYLNAS/<u>GGGGSGGGGS</u>/EPKSSDKTHTCPPC
PAPPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 353)

Figure 50

>XENP31290 human_IL12p40(E59K/K99E)_(GGGGS)5-human_IL12p35_(GGGGS)2_(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL12p40(E59K/K99E)_(GGGGS)5-human_IL12p35_(GGGGS)2_(single-chain)_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVLSHS
LLLLHKKEDGIWSTDILKDQEEPKNKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS/<u>GGGGSGGGGS
GGGGSGGGGSGGGGS</u>/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVID
ELMQALNFNSETVPQKSSLEEPDFYKTKIKLCILLHAFRIRAVTIDRVMSYLNAS/<u>GGGGSGGGGS</u>/EPKSSDKTHTCPPC
PAPPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 424)

Chain 2 - empty-Fc(216)_IgG1_C220S/PVA_/S267K/S364K/E357Q

EPKSSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK (SEQ ID NO: 467)

Figure 52

| XENP | Format | IL-12p40 Variant | IL-12p30 Variant | pSTAT4 EC50 (µg/ml) | |
|---|---|---|---|---|---|
| | | | | CD4+ CD45RA+ CD25+ | CD8+ CD45RA+ CD25+ |
| 27201 | IL-12-heteroFc | WT | WT | 0.2535 | 0.3516 |
| 27203 | scIL-12(p40/p35)-Fc | WT | WT | 0.1205 | 0.1743 |
| 31289 | (scIL-12(P40/P35))2-Fc | WT | WT | 0.3151 | 0.4397 |
| 31290 | scIL-12(p40/p35)-Fc | E59K/K99E | WT | 8.005 | 9.459 |
| 31291 | (scIL-12(P40/P35))2-Fc | E59K/K99E | WT | 4.241 | 5.549 |

Figure 53

> XENP016432 Nivolumab_H0L0_IgG1_PVA_/S267K

XENP016432 Nivolumab_H0L0_IgG1_PVA_/S267K Heavy Chain

QVQLVESGGGVVQPGRSLRLDCKASGITFS<u>NSGMH</u>WVRQAPGKGLEWVA<u>VIWYDGSKRYYADSVKG</u>RFTISRDNSK
NTLFLQMNSLRAEDTAVYYCAT<u>NDDY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK (SEQ ID NO: 355)

XENP016432 Nivolumab_H0L0_IgG1_PVA_/S267K Light Chain

EIVLTQSPATLSLSPGERATLSC<u>RASQSVSSYLA</u>WYQQKPGQAPRLLIY<u>DASNRAT</u>GIPARFSGSGSGTDFTLTISSLEPED
FAVYYC<u>QQSSNWPRT</u>FGQGTKVEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC (SEQ ID NO: 356)

Figure 58A
Figure 58B
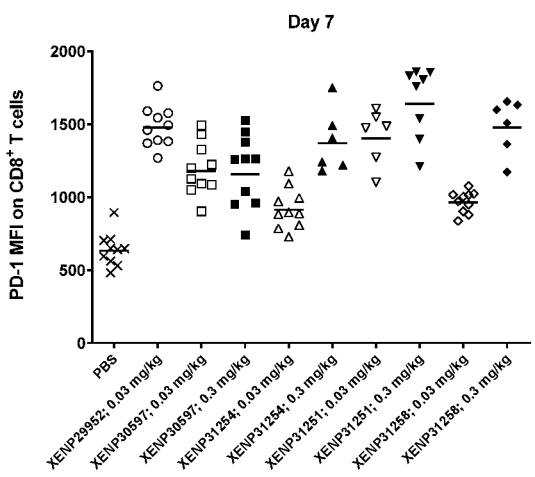
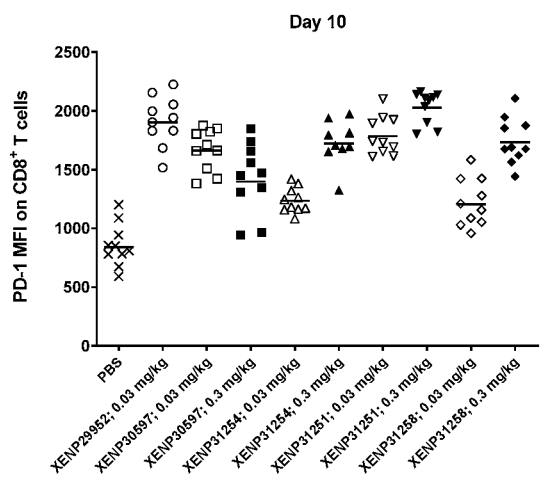
Figure 58C
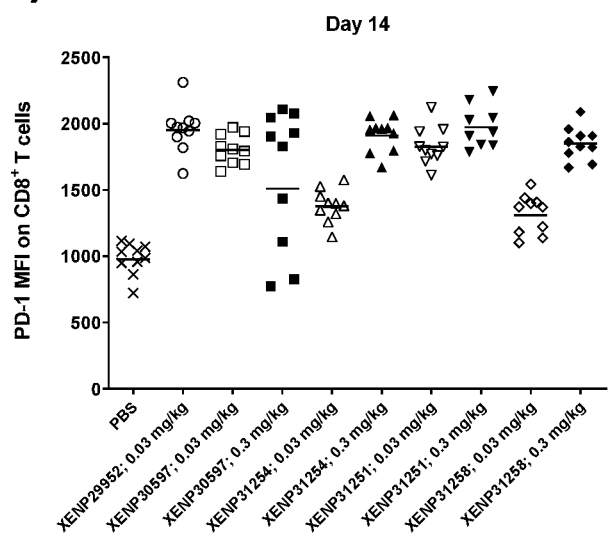

Figure 59A
Figure 59B
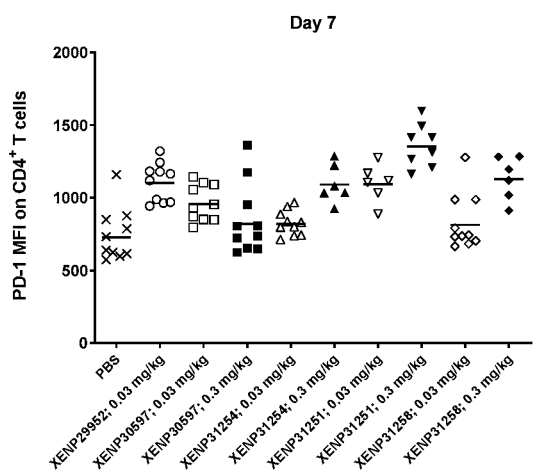
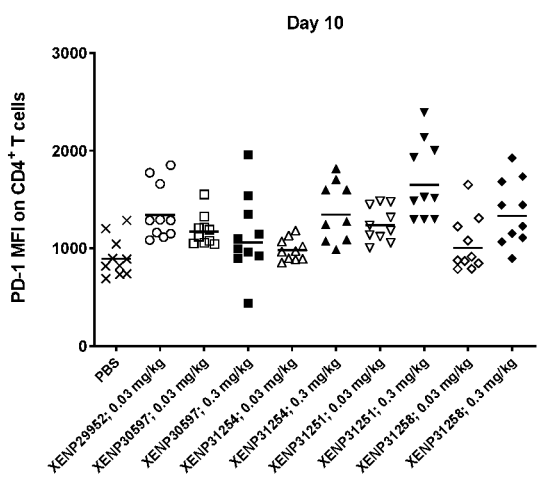
Figure 59C
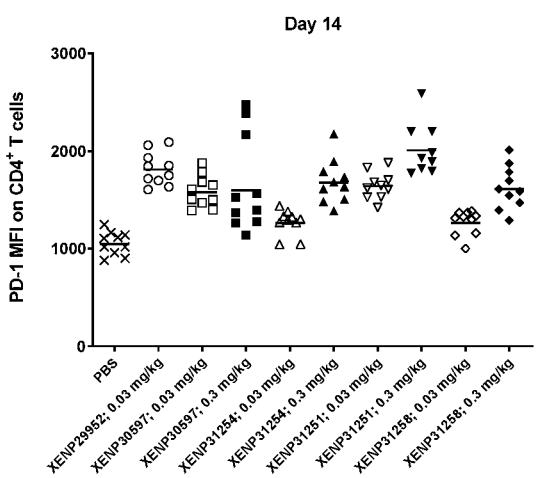

Figure 61A
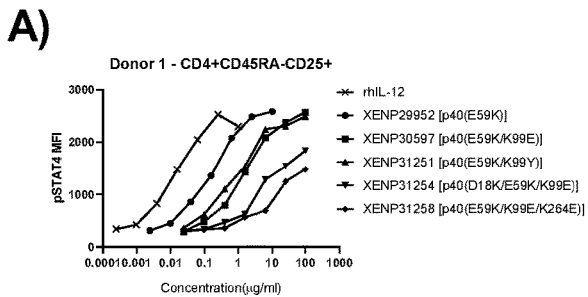
Figure 61B
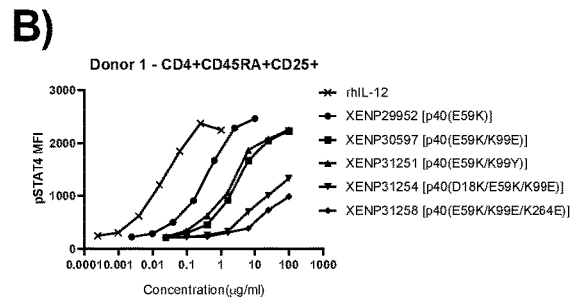
Figure 61C
Figure 61D
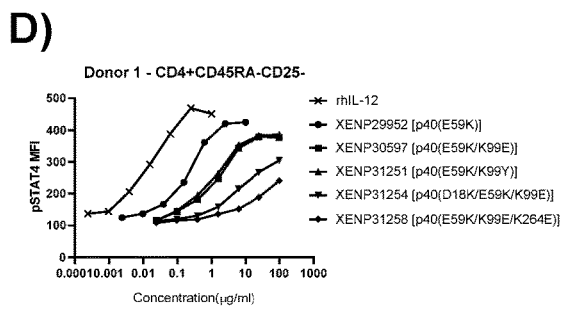
Figure 61E
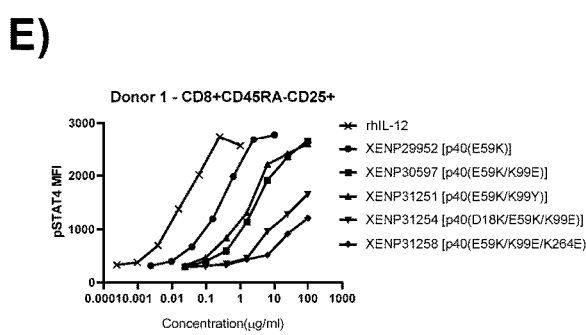
Figure 61F
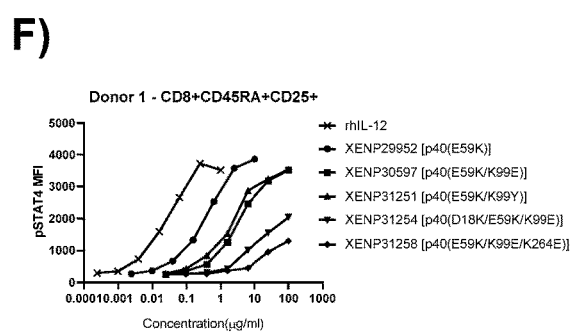

Figure 64A

>XENP31582 human_IL12p40(D18K/E59K/K99E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(D18K/E59K/K99E)_(GGGGS)2_Fc(216)_IgG1_pI(-)_Isosteric_A_C220S/PVA_/S267K/L368D/K370S/M428L/N434S IWELKKDVYVVELDWYPKAPGEMVVLTCDTPEEDGITWTLDQSSEVLGSGKTLTIQVKKFGDAGQYTCHKGGEVLSHS
LLLLHKKEDGIWSTDILKDQEEPKNKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS/GGGGSGGGGS/
EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVLHEALHSHYTQKSLSLSPGK (SEQ ID NO: 357)

Chain 2 - human_IL12p35_(GGGGS)2_Fc(216)_IgG1_C220S/PVA_/S267K/S364K/E357Q/M428L/N434S RNLPVATPDPGMFPCLHHSQNLLRAVSNMLQKARQTLEFYPCTSEEIDHEDITKDKTSTVEACLPLELTKNESCLNSRET
SFITNGSCLASRKTSFMMALCLSSIYEDLKMYQVEFKTMNAKLLMDPKRQIFLDQNMLAVIDELMQALNFNSETVPQK
SSLEEPDFYKTKIKLCILLHAFRIRAVTIDRVMSYLNAS/GGGGSGGGGS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK (SEQ ID NO: 421)

Figure 64B

>XENP31583 human_IL12p40(E59K/K99Y)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99Y)_(GGGGS)2_Fc(216)_IgG1_pI(-)_Isosteric_A_C220S/PVA_/S267K/L368D/K370S/M428L/N434S IWELKKDVYVVELDWYPDAPGEMVVLTCDTPEEDGITWTLDQSSEVLGSGKTLTIQVKKFGDAGQYTCHKGGEVLSHS
LLLLHKKEDGIWSTDILKDQYEPKNKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKKDRVFTDKTSATVICRKNASISVRAQDRYYSSSWSEWASVPCS/GGGGSGGGGS/
EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVLHEALHSHYTQKSLSLSPGK (SEQ ID
NO: 358)

Chain 2 - human_IL12p35_(GGGGS)2_Fc(216)_IgG1_C220S/PVA_/S267K/S364K/E357Q/M428L/N434S RNLPVATPDPGMFPCLHHSQNLLRAVSNMLQKARQTLEFYPCTSEEIDHEDITKDKTSTVEACLPLELTKNESCLNSRET
SFITNGSCLASRKTSFMMALCLSSIYEDLKMYQVEFKTMNAKLLMDPKRQIFLDQNMLAVIDELMQALNFNSETVPQK
SSLEEPDFYKTKIKLCILLHAFRIRAVTIDRVMSYLNAS/GGGGSGGGGS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK (SEQ ID NO: 422)

Figure 64C

>XENP31584 human_IL12p40(E59K/K99E/K264E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99E/K264E)_(GGGGS)2_Fc(216)_IgG1_pI(-)_Isosteric_A_C220S/PVA_/S267K/L368D/K370S/M428L/N434S IWELKKDVYVVELDWYPDAPGEMVVLTCDTPEEDGITWTLDQSSEVLGSGKTLTIQVKKFGDAGQYTCHKGGEVLSHS
LLLLHKKEDGIWSTDILKDQEEPKNKTFLRCEAKNYSGRFTCWWLTTISTDLTFSVKSSRGSSDPQGVTCGAATLSAERVR
GDNKEYEYSVECQEDSACPAAEESLPIEVMVDAVHKLKYENYTSSFFIRDIIKPDPPKNLQLKPLKNSRQVEVSWEYPDT
WSTPHSYFSLTFCVQVQGKSKREKEDRVFTDKTSATVICRKNASISVRAQDRYYSSSWSEWASVPCS/GGGGSGGGGS/
EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVLHEALHSHYTQKSLSLSPGK (SEQ ID NO: 359)

Chain 2 - human_IL12p35_(GGGGS)2_Fc(216)_IgG1_C220S/PVA_/S267K/S364K/E357Q/M428L/N434S RNLPVATPDPGMFPCLHHSQNLLRAVSNMLQKARQTLEFYPCTSEEIDHEDITKDKTSTVEACLPLELTKNESCLNSRET
SFITNGSCLASRKTSFMMALCLSSIYEDLKMYQVEFKTMNAKLLMDPKRQIFLDQNMLAVIDELMQALNFNSETVPQK
SSLEEPDFYKTKIKLCILLHAFRIRAVTIDRVMSYLNAS/GGGGSGGGGS/EPKSSDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGS
FFLYSKLTVDKSRWQQGNVFSCSVLHEALHSHYTQKSLSLSPGK (SEQ ID NO: 423)

IWELKKDVYVVELDWYPDAPGEMVVLTCDTPEEDGITWTLDQSSEVLGSGKTLTIQVKEFGDAGQYTCHKGGEVLSH
SLLLLHKKEDGIWSTDILKDQKEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS
(SEQ ID NO: 360)

> IL-12p40(D18K/E59K/K99E/C252S)

IWELKKDVYVVELDWYPKAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS
(SEQ ID NO: 361)

> IL-12p40(D18K/E59K/K99E/C252S/K264E)

IWELKKDVYVVELDWYPKAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 362)

> IL-12p40(E59K/K99Y/C252S)

IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQYEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS
(SEQ ID NO: 363)

> IL-12p40(E59K/K99E/C252S/K264E)

IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 364)

> IL-12p40(E59K/K99E/C252S)

IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS
(SEQ ID NO: 365)

Figure 65B

>IL-12p40(E59K/K99E/N103Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 366)

>IL-12p40(E59K/K99E/N113Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 367)

>IL-12p40(E59K/K99E/N200Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 368)

>IL-12p40(E59K/K99E/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 369)

>IL-12p40(E59K/K99E/N103Q/N113Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 370)

>IL-12p40(E59K/K99E/N103Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 371)

>IL-12p40(E59K/K99E/N103Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 372)

Figure 65C

>IL-12p40(E59K/K99E/N113Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 373)

>IL-12p40(IL12p40_E59K/K99E/N113Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 374)

>IL-12p40(E59K/K99E/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 375)

>IL-12p40(E59K/K99E/N103Q/N113Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS
(SEQ ID NO: 376)

>IL-12p40(E59K/K99E/N103Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 377)

>IL-12p40(E59K/K99E/N113Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 378)

>IL-12p40(E59K/K99E/N103Q/N113Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS
(SEQ ID NO: 379)

Figure 66A

>XENP32187 human_IL12p40(D18K/E59K/K99E/C252S)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(D18K/E59K/K99E/C252S)_(GGGGS)2_Fc(216)_IgG1_pI(-)_Isosteric_A_C220S/PVA_/S267K/L368D/K370S

*IWELKKDVYVVELDWYPKAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 380)

Chain 2 - IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 402)

>XENP32188 human_IL12p40(D18K/E59K/K99E/C252S/K264E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(D18K/E59K/K99E/C252S/K264E)_(GGGGS)2_Fc(216)_IgG1_pI(-)_Isosteric_A_C220S/PVA_/S267K/L368D/K370S

*IWELKKDVYVVELDWYPKAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 381)

Chain 2 - IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 403)

Figure 66B

>XENP32189 human_IL12p40(E59K/K99Y/C252S)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99Y/C252S)_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQYEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 382)

Chain 2 - IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 404)

>XENP32190 human_IL12p40(E59K/K99E/C252S/K264E)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 425)

Chain 2 - IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 405)

Figure 66C

>XENP32191 human_IL12p40(E59K/K99E/C252S)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKKDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 384)

Chain 2 - IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 406)

>XENP32991 human_IL12p40_E59K/K99E/N103Q/C252S/K264E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

> IL-12p40(E59K/K99E/N103Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 385)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 407)

Figure 66D

>XENP32992 human_IL12p40_E59K/K99E/N113Q/C252S/K264E_(GGGGS)2-human_IL12p35_(GGGGS)2-Fc(216)_IgG1_pI(-)_Isosteric_A_C220S/PVA_/S267K/L368D/K370S Fc(216)_IgG1_C220S/PVA_/S267K/S364K/E357Q

> IL-12p40(E59K/K99E/N113Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 386)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 408)

>XENP32993 human_IL12p40_E59K/K99E/N200Q/C252S/K264E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

> IL-12p40(E59K/K99E/N200Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 387)

Figure 66E

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 409)

<u>>XENP32994 human_IL12p40_E59K/K99E/N281Q/C252S/K264E_(GGGGS)2-human_IL12p35_(GGGGS)2-
Fc(216)_IgG1_pI(-
)_Isoteric_A_C220S/PVA_/S267K/L368D/K370S_Fc(216)_IgG1_C220S/PVA_/S267K/S364K/E357Q</u>

> IL-12p40(E59K/K99E/N281Q/C252S/K264E_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS*/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 388)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 410)

Figure 66F

>XENP32995 human_IL12p40_E59K/K99E/N103Q/N113Q/C252S/K264E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

> IL-12p40(E59K/K99E/N103Q/N113Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH*
*SLLLLHKKEDGIWSTDILKDQEEPKQKTFLRCEAKQYSGRFTCWWLTTISTDLTFSVKSSRGSSDPQGVTCGAATLS*
*AERVRGDNKEYEYSVECQEDSACPAAEESLPIEVMVDAVHKLKYENYTSSFFIRDIIKPDPPKNLQLKPLKNSRQVE*
*VSWEYPDTWSTPHSYFSLTFSVQVQGKSKREKEDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 389)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 411)

>XENP32996 human_IL12p40_E59K/K99E/N103Q/N200Q/C252S/K264E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

> IL-12p40(E59K/K99E/N103Q/N200Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH*
*SLLLLHKKEDGIWSTDILKDQEEPKQKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYEQYTSSFFIRDIIKPDPPKNLQLKPLKNSRQVE*
*VSWEYPDTWSTPHSYFSLTFSVQVQGKSKREKEDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 390)

Figure 66G

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 412)

**>XENP32997 human_IL12p40_E59K/K99E/N103Q/N281Q/C252S/K264E_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q**

**> IL-12p40(E59K/K99E/N103Q/N281Q/C252S/K264E_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 391)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 413)

Figure 66H

>XENP32998 human_IL12p40_E59K/K99E/N113Q/N200Q/C252S/K264E_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q > IL-12p40(E59K/K99E/N113Q/N200Q/C252S/K264E_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 392)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 414)

>XENP32999 human_IL12p40_E59K/K99E/N113Q/N281Q/C252S/K264E_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q > IL-12p40(E59K/K99E/N113Q/N281Q/C252S/K264E_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 393)

Figure 66I

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 415)

>XENP33000 human_IL12p40_E59K/K99E/N200Q/N281Q/C252S/K264E_(GGGGS)2-human_IL12p35_(GGGGS)2-Fc(216)_IgG1_pI(-)_Isoteric_A_C220S/PVA_/S267K/L368D/K370S_Fc(216)_IgG1_C220S/PVA_/S267K/S364K/E357Q

> IL-12p40(E59K/K99E/N200Q/N281Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH*
*SLLLLHKKEDGIWSTDILKDQEEPKNKTFLRCEAKNYSGRFTCWWLTTISTDLTFSVKSSRGSSDPQGVTCGAATLS*
*AERVRGDNKEYEYSVECQEDSACPAAEESLPIEVMVDAVHKLKYEQYTSSFFIRDIIKPDPPKNLQLKPLKNSRQVE*
*VSWEYPDTWSTPHSYFSLTFSVQVQGKSKREKEDRVFTDKTSATVICRKQASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 394)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS*
*RETSFITNGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 416)

Figure 66J

>XENP33001 human_IL12p40_E59K/K99E/N103Q/N113Q/N200Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q > IL-12p40(E59K/K99E/N103Q/N113Q/N200Q/C252S/K264E_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 395)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 417)

>XENP33002 human_IL12p40_E59K/K99E/N103Q/N200Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q > IL-12p40(E59K/K99E/N103Q/N200Q/N281Q/C252S/K264E_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 396)

Figure 66K

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 418)

<u>>XENP33003 human_IL12p40_E59K/K99E/N113Q/N200Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q</u>

> IL-12p40(E59K/K99E/N113Q/N200Q/N281Q/C252S/K264E_(GGGGS)2_Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS*/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 397)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 419)

Figure 66L

>XENP33004 human_IL12p40_E59K/K99E/N103Q/N113Q/N200Q/N281Q/C252S/K264E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

> IL-12p40(E59K/K99E/N103Q/N113Q/N200Q/N281Q/C252S/K264E_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKQKTFLRCEAKQYSGRFTCWWLTTISTDLTFSVKSSRGSSDPQGVTCGAATLS
AERVRGDNKEYEYSVECQEDSACPAAEESLPIEVMVDAVHKLKYEQYTSSFFIRDIIKPDPPKNLQLKPLKNSRQVE
VSWEYPDTWSTPHSYFSLTFSVQVQGKSKREKEDRVFTDKTSATVICRKQASISVRAQDRYYSSSWSEWASVPCS/*<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 398)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 420)

>XENP33005 human_IL12p40(E59K/K99E/C252S/K264E)_(GGGGS)2-human_IL12p35(N71Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/*<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 426)

Figure 66M

Chain 2 - human_IL12p35(N71Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKQESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 399)

>XENP33006 human_IL12p40(E59K/K99E/C252S/K264E)_(GGGGS)2-human_IL12p35(N85Q)_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q

**Chain 1 - human_IL12p40(E59K/K99E/C252S/K264E)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS*/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 427)

Chain 2 - human_IL12p35(N85Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 400)

Figure 66N

>XENP33007 human_IL12p40(E59K/K99E/C252S/K264E)_(GGGGS)2-human_IL12p35(N195Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 428)

Chain 2 - human_IL12p35(N195Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 401)

>XENP33008 human_IL12p40(E59K/K99E/C252S/K264E)_(GGGGS)2-human_IL12p35(N71Q/N85Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 429)

Figure 66O

Chain 2 - human_IL12p35(N71Q/N85Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKQESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLNAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 289)

>XENP33009 human_IL12p40(E59K/K99E/C252S/K264E)_(GGGGS)2-human_IL12p35(N71Q/N195Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS*/<u>G
GGGSGGGGS</u>/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK (SEQ ID NO: 430)

Chain 2 - human_IL12p35(N71Q/N195Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKQESCLNS
RETSFITNGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 290)

Figure 66P

>XENP33010 human_IL12p40(E59K/K99E/C252S/K264E)_(GGGGS)2-human_IL12p35(N85Q/N195Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 431)

Chain 2 - human_IL12p35(N85Q/N195Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCLNS
RETSFITQGSCLASRKTSFMMALCLSSIYEDLKMYQVEFKTMNAKLLMDPKRQIFLDQNMLAVIDELMQALNFNSET
VPQKSSLEEPDFYKTKIKLCILLHAFRIRAVTIDRVMSYLQAS/GGGGSGGGGS/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK* (SEQ ID NO: 352)

>XENP33011 human_IL12p40(E59K/K99E/C252S/K264E)_(GGGGS)2-human_IL12p35(N71Q/N85Q/N195Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/C252S/K264E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVLSH
SLLLLHKKEDGIWSTDILKDQEEPKNKTFLRCEAKNYSGRFTCWWLTTISTDLTFSVKSSRGSSDPQGVTCGAATLS
AERVRGDNKEYEYSVECQEDSACPAAEESLPIEVMVDAVHKLKYENYTSSFFIRDIIKPDPPKNLQLKPLKNSRQVE
VSWEYPDTWSTPHSYFSLTFSVQVQGKSKREKEDRVFTDKTSATVICRKNASISVRAQDRYYSSSWSEWASVPCS/G
GGGSGGGGS/EPKSSDKTHTCPPCPAPPVAGPSVFLFPPKPKDTLMISRTPEVTCVVVDVKHEDPEVKFNWYVDGVE
VHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYT
QKSLSLSPGK* (SEQ ID NO: 383)

Figure 66Q

Chain 2 - human_IL12p35(N71Q/N85Q/N195Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKQESCLNS*
*RETSFITQGSCLASRKTSFMMALCLSSIYEDLKMYQVEFKTMNAKLLMDPKRQIFLDQNMLAVIDELMQALNFNSET*
*VPQKSSLEEPDFYKTKIKLCILLHAFRIRAVTIDRVMSYLQAS*/<u>GGGGSGGGGS</u>/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK (SEQ ID NO: 354)

A)

B)

C)

D)

E)

Open symbols: C252S
- XENP27201 [WT]
- XENP31251 [p40(E59K/K99Y)]
- XENP31254 [p40(D18K/E59K/K99E)]
- XENP31258 [p40(E59K/K99E/K264E)]
- XENP32186 [p40(D18K/E59K/K99E/K264E)]
- XENP32187 [p40(D18K/E59K/K99E/C252S)]
- XENP32188 [p40(D18K/E59K/K99E/C252S/K264E)]
- XENP32189 [p40(E59K/K99Y/C252S)]
- XENP32190 [p40(E59K/K99E/C252S/K264E)]
- XENP32191 [p40(E59K/K99E/C252S)]

IL-12 HETERODIMERIC FC-FUSION PROTEINS

CROSS-REFERENCE TO RELATED APPLICATIONS

This application claims the benefit of U.S. Provisional Application No. 62/740,813, filed Oct. 3, 2018, U.S. Provisional Application No. 62/810,038 filed Feb. 25, 2019, and U.S. Provisional Application No. 62/848,512 filed May 15, 2019 all of which are incorporated herein by reference in their entirety for all purposes.

SEQUENCE LISTING

The instant application contains a Sequence Listing which has been submitted electronically in ASCII format and is hereby incorporated by reference in its entirety. Said ASCII copy, created on Nov. 21, 2019, is named 067461-5225-US_SL.txt and is 1,640,919 bytes in size.

BACKGROUND OF THE INVENTION

In order for T cells to mount an effective anti-tumor response, three things must occur. T cells must first engage antigenic tumor peptides presented by MHC in the tumor environment. Second, costimulatory molecules must bind to the T cells. And third, the T cells must be induced by cytokines such as IL-12 and IL-2 to produce costimulatory cytokines such as IFNγ which allows differentiation and expansion. Recognition of tumor peptides alone in the absence of cytokine induction leads to T cells becoming anergic, thereby leading to tolerance. Accordingly, a very promising approach in cancer immunotherapy is cytokine-based treatments. In fact, IL-2 has been approved for use in patients with metastatic renal-cell carcinoma and malignant melanoma. However, there are currently no approved uses of recombinant IL-12 in humans.

Recombinant IL-12 is a promising cytokine-based treatment due to its broad effect in activating the immune system. However, IL-12 has thus far faced hurdles in human clinical trials due to toxicity. As with other cytokines, the short half-life of IL-12 requires frequent bolus injections.

Additionally, IL-12 is composed of an α-chain (the p35 subunit; IL-12p35) and a β-chain (the p40 subunit; IL-12p40) covalently linked to form the biologically active IL-12 heterodimer. IL-12 exerts its cell signaling function through binding by binding to a dimeric IL-12 receptor complex composed of IL-12 receptor β1 (IL-12Rβ1) and IL-12 receptor β2 (IL-12Rβ2) on T cells and inducing IFNγ secretion. However, the IL-12p40 subunit can also exist as a homodimer which has been reported to antagonize IL-12 activity by competing for binding to IL-12 receptor.

The present invention addresses the short half-life of IL-12 by providing novel IL-12-Fc fusion proteins, as well as novel IL-12 variants with decreased potency.

BRIEF SUMMARY OF THE INVENTION

In one aspect, the present invention provides a heterodimeric Fc fusion protein comprising: a) a first fusion protein comprising a variant IL-12p40 subunit domain and a first Fc domain, wherein said IL-12p40 subunit domain is covalently attached to the N-terminus of said first Fc domain; and b) a second fusion protein comprising an IL-12p35 subunit domain and a second Fc domain, wherein said IL-12p35 subunit domain is covalently attached to the N-terminus of said Fc domain; wherein said first and said second Fc domains comprise modifications promoting heterodimerization of said first and said second Fc domains. In some embodiments, the present invention provides a heterodimeric Fc fusion protein, wherein said IL-12p40 subunit has one or more amino acid substitutions selected from the group consisting of: E59K, E59Q, D18N, D18K, E32Q, E33Q, D34N, D34K, Q42E, S43E, S43K, E45Q, Q56E, D62N, E73Q, D87N, K99E, K99Y, E100Q, N10D, N103Q, N113D, N103Q, N13D, N13Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric Fc fusion protein, wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N103Q/N113Q/N200Q/C252S/K264E, E59K/K99E/N103Q/N113Q/N281Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a heterodimeric Fc fusion protein, wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40 (N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40 (E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40 (D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40 (Q256N)), xxvii) SEQ ID NO:83 (IL-12p40(E299Q)), xxviii) SEQ ID NO:84 (IL-12p40(D87N)), xxix) IL-12p40 (E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/ K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/ E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40 (E59Q/K163E)), xlvi) SEQ ID NO:212 (IL-12p40(E59Q/ K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/ E59K/K99E)), lvi) SEQ ID NO: 340 (IL-12p40 (E59K/ K99E/Q144E)), lvii) SEQ ID NO: 341 (IL-12p40 (E59K/ K99E/Q144K)), lviii) SEQ ID NO: 342 (IL-12p40 (E59K/ K99E/R159E)), lix) SEQ ID NO: 343 (IL-12p40 (E59K/ K99E/K264E)), lx) SEQ ID NO: 344 (IL-12p40 (D18K/ E59K/K99E/K264E)), lxi) SEQ ID NO: 360 (IL-12p40 (C252S)), lxii) SEQ ID NO: 361 (IL-12p40 (D18K/E59K/ K99E/C252S)), lxiii) SEQ ID NO: 362 (IL-12p40 (D18K/ E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/ N200Q)), lxxxviii) SEQ ID NO: 275 (IL-12p40 (N103Q/ N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/ C252S/K264E)), xcix) SEQ ID NO:368 (IL-12p40 (E59K/ K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/ K264E)), cii) SEQ ID NO:371 (IL-12p40 (E59K/K99E/ N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/ C252S/K264E)), cv) SEQ ID NO:374 (IL-12p40 (E59K/ K99E/N113Q/N281Q/C252S/K264E)), cvi) SEQ ID NO:375 (IL-12p40 (E59K/K99E/N200Q/N281Q/C252S/ K264E)), cvii) SEQ ID NO:376 (IL-12p40 (E59K/K99E/ N103Q/N113Q/N200Q/C252S/K264E)), cviii) SEQ ID NO:377 (IL-12p40 (E59K/K99E/N103Q/N200Q/N281Q/ C252S/K264E)), and cix) SEQ ID NO:378 (IL-12p40 (E59K/K99E/N113Q/N200Q/N281Q/C252S/K264E)).

In some embodiments, the present invention provides a heterodimeric Fc fusion protein, wherein said variant IL-12p40 subunit has at least 90% identity to a polypeptide sequence selected from the group consisting of SEQ ID NO:3 (human IL-12 subunit beta (IL-12p40) precursor sequence) and SEQ ID NO:4 (human IL-12 subunit beta (IL-12p40) mature form sequence), and/or said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric Fc fusion protein, wherein said IL-12p35 subunit is a variant IL-12p35 subunit.

In some embodiments, the present invention provides a heterodimeric Fc fusion protein, wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric Fc fusion protein, wherein said variant IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric Fc fusion protein, wherein said variant IL-12p35 subunit has amino acid substitutions selected from the group consisting of: N71D/N85D/N195D, N151D/ E153Q, N151D/D165N, Q130E/N151D, N151D/K158E, E79Q/N151D, D55Q/N151D, N136D/N151D, N21D/ N151D, E143Q/N151D, N71Q/N85Q, N71Q/N195Q, N85Q/N195Q, N71Q/N85Q/N195Q, N71D/N85D, N71D/ N195D, and N85D/N195D.

In some embodiments, the present invention provides a heterodimeric Fc fusion protein, wherein said variant IL-12p35 subunit has a polypeptide sequence selected from the group consisting of: i) SEQ ID NO:113 (IL-12p35 (N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL- 12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35 (D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L9A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a heterodimeric Fc fusion protein, wherein said modifications promoting heterodimerization of said first and said second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; T366S/L368A/Y407V/Y349C and T366W/S354C, according to EU numbering.

In some embodiments, the present invention provides a heterodimeric Fc fusion protein, wherein said variant IL-12p40 subunit domain is attached to said first Fc domain using a first domain linker and/or said IL-12p35 subunit domain is attached to said second Fc domain using a second domain linker.

In some embodiments, the present invention provides a heterodimeric Fc fusion protein, wherein said first and/or said second Fc domains have an additional set of amino acid substitutions comprising Q295E/N384D/Q418E/N421D, according to EU numbering.

In some embodiments, the present invention provides a heterodimeric Fc fusion protein, wherein said first and/or said second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a heterodimeric Fc fusion protein, wherein said first and second Fc domains further comprise amino acid substitutions M428L/N424S.

In some embodiments, the present invention provides a heterodimeric Fc fusion protein, wherein said heterodimeric Fc fusion protein comprises:
a) said first fusion protein having a polypeptide sequence selected from the group consisting of: i) SEQ ID NO:47 (XENP27201 Chain 1), ii) SEQ ID NO:85 (XenD24752), iii) SEQ ID NO:86 (XenD24753), iv) SEQ ID NO:87 (XenD24754), v) SEQ ID NO:88 (XenD24755), vi) SEQ ID NO:89 (XenD24756), vii) SEQ ID NO:90 (XenD24757), viii) SEQ ID NO:91 (XenD24758), ix) SEQ ID NO:92 (XenD24759), x) SEQ ID NO:93 (XenD24760), xi) SEQ ID NO:94 (XenD24761), xii) SEQ ID NO:95 (XenD24762), xiii) SEQ ID NO:96 (XenD24763), xiv) SEQ ID NO:97 (XenD24764), xv) SEQ ID NO:98 (XenD24765), xvi) SEQ ID NO:99 (XenD24766), xvii) SEQ ID NO:100 (XenD24767), xviii) SEQ ID NO:101 (XenD24768), xix) SEQ ID NO:102 (XenD24769), xx) SEQ ID NO:103 (XenD24770), xxi) SEQ ID NO:104 (XenD24771), xxii) SEQ ID NO:105 (XenD24772), xxiii) SEQ ID NO:106 (XenD24773), xxiv) SEQ ID NO:107 (XenD24774), xxv) SEQ ID NO:108 (XenD24775), xxvi) SEQ ID NO:109 (XenD24776), xxvii) SEQ ID NO:110 (XenD24777), xxviii) SEQ ID NO:111 (XenD24778), xxix) SEQ ID NO:112 (XenD24792), xxx) SEQ ID NO:215 (XenD25922), xxxi) SEQ ID NO:216 (XenD25923), xxxii) SEQ ID NO:217 (XenD25924), xxxiii) SEQ ID NO:218 (XenD25925), xxxiv) SEQ ID NO:219 (XenD25926), xxxv) SEQ ID NO:220(XenD25927), xxxvi) SEQ ID NO:221 (XenD25928), xxxvii) SEQ ID NO:222 (XenD25929), xxxviii) SEQ ID NO:223 (XenD25930), xxxix) SEQ ID NO:224 (XenD25931), xl) SEQ ID NO:291 (XenD26411), xli) SEQ ID NO:292 (XenD26412), xlii) SEQ ID NO:293 (XenD26413), xliii) SEQ ID NO:294 (XenD26414), xliv) SEQ ID NO:295 (XenD26415), xlv) SEQ ID NO:296 (XenD26416), xlvi) SEQ ID NO:297 (XenD26417), xlvii) SEQ ID NO:298 (XenD26418), xlviii) SEQ ID NO:301 (XenD27070), xlix) SEQ ID NO:302 (XenD27071), l) SEQ ID NO:303 (XenD27072), li) SEQ ID NO:304 (XenD27073), lii) SEQ ID NO:305 (XenD27074), liii) SEQ ID NO-306 (XenD27075), liv) SEQ ID NO:307 (XenD27076), lv) SEQ ID NO:308 (XenD27077), lvi) SEQ ID NO:309 (XenD27078), lvii) SEQ ID NO:317 (XenD28173), lviii) SEQ ID NO:318 (XenD24876), lix) SEQ ID NO:320 (XenD27162), lx) SEQ ID NO:321 (XenD27163), lxi) SEQ ID NO:323 (XenD27164), lxii) SEQ ID NO:324 (XenD27165) lxiii) SEQ ID NO:357 (XENP31582 Chain 1), lxiv) SEQ ID NO:358 (XENP31583 Chain 1), lxv) SEQ ID NO:359 (XENP31584 Chain 1), lxvi) SEQ ID NO:380 (XENP32187 Chain 1), lxvii) SEQ ID NO:381 (XENP32188 Chain 1), lxviii) SEQ ID NO:382 (XENP32189, Chain 1), lxix) SEQ ID NO:425 (XENP32190 Chain 1), lxx) SEQ ID NO:384 (XENP32191 Chain 1), lxxi) SEQ ID NO:385 (XENP32991 Chain 1), lxxii) SEQ ID NO:386 (XENP32992 Chain 1), lxxiii) SEQ ID NO:387 (XENP32993 Chain 1), lxxiv) SEQ ID NO:388 (XENP32994 Chain 1), lxxv) SEQ ID NO:389 (XENP32995 Chain 1), lxxvi) SEQ ID NO:390 (XENP32996 Chain 1), lxxvi) SEQ ID NO:391

(XENP32997 Chain 1), lxxvii) SEQ ID NO:392 (XENP32998 Chain 1), lxxvii) SEQ ID NO:393 (XENP32999 Chain 1), lxxviii) SEQ ID NO:394 (XENP33000 Chain 1), lxxix) SEQ ID NO:395 (XENP33001 Chain 1), lxxx) SEQ ID NO:3% (XENP33002 Chain 1), lxxxi) SEQ ID NO:397 (XENP33003 Chain 1), lxxxii) SEQ ID NO:398 (XENP33004 Chain 1), lxxxiii) SEQ ID NO:426 (XENP33005 Chain 1), lxxxiv) SEQ ID NO:427 (XENP33006 Chain 1), lxxxv) SEQ ID NO:428 (XENP33007 Chain 1), lxxxvi) SEQ ID NO:429 (XENP33008 Chain 1), lxxxvii) SEQ ID NO:429 (XENP33008 Chain 1), lxxxviii) SEQ ID NO:430 (XENP33009 Chain 1), lxxxix) SEQ ID NO:431 (XENP33010 Chain 1), and xc) SEQ ID NO:383 (XENP33011 Chain 1); and b) said second fusion protein having a polypeptide sequence selected from the group consisting of: i) SEQ ID NO:48 (XENP27201 Chain 2), ii) SEQ ID NO:126 (XenD24779), iii) SEQ ID NO:127 (XenD24780), iv) SEQ ID NO:128 (XenD24781), v) SEQ ID NO:129 (XenD24782), vi) SEQ ID NO:130 (XenD24783), vii) SEQ ID NO:131 (XenD24784), viii) SEQ ID NO:132 (XenD24785), ix) SEQ ID NO:133 (XenD24786), x) SEQ ID NO:134 (XenD24787), xi) SEQ ID NO:135 (XenD24788), xii) SEQ ID NO:136 (XenD24789), xiii) SEQ ID NO:137 (XenD24790), xiv) SEQ ID NO:138 (XenD24791), xv) SEQ ID NO:236 (XenD25911), xvi) SEQ ID NO:237 (XenD25912), xvii) SEQ ID NO:238 (XenD25913), xviii) SEQ ID NO:239 (XenD25914), xix) SEQ ID NO:240 (XenD25915), xx) SEQ ID NO:241 (XenD25916), xxi) SEQ ID NO:242 (XenD25917), xxii) SEQ ID NO:243 (XenD25918), xxiii) SEQ ID NO:244 (XenD25919), xxiv) SEQ ID NO:245 (XenD25920), xxv) SEQ ID NO:246 (XenD25921), xxvi) SEQ ID NO:299 (XenD26427), xxvii) SEQ ID NO:300 (XenD26428), xxviii) SEQ ID NO:311 (XenD27089), xxix) SEQ ID NO:312 (XenD27090), xxx) SEQ ID NO:313 (XenD27091), xxxi) SEQ ID NO:314 (XenD27092), xxxii) SEQ ID NO:315 (XenD27093), xxxiii) SEQ ID NO:316 (XenD27094), xxxix) SEQ ID NO:319 (XenD24877), xl) SEQ ID NO:322 (XenD27166), xli) SEQ ID NO:421 (XENP31582 Chain 2), xlii) SEQ ID NO:422 (XENP31583 Chain 2), xliii) SEQ ID NO:423 (XENP31584 Chain 2), xliv) SEQ ID NO:402 (XENP32187 Chain 2), xlv) SEQ ID NO:403 (XENP32188 Chain 2), xlvi) SEQ ID NO:404 (XENP32189, Chain 2), xlvii) SEQ ID NO:405 (XENP32190 Chain 2), xlviii) SEQ ID NO:406 (XENP32191 Chain 2), xlix) SEQ ID NO:407 (XENP32991 Chain 2), l) SEQ ID NO:408 (XENP32992 Chain 2), li) SEQ ID NO:409 (XENP32993 Chain 2), lii) SEQ ID NO:410 (XENP32994 Chain 2), liii) SEQ ID NO:411 (XENP32995 Chain 2), liv) SEQ ID NO:412 (XENP32996 Chain 2), lv) SEQ ID NO:413 (XENP32997 Chain 2), lvi) SEQ ID NO:414 (XENP32998 Chain 2), lvii) SEQ ID NO:415 (XENP32999 Chain 2), lviii) SEQ ID NO:416 (XENP33000 Chain 2), lix) SEQ ID NO:417 (XENP33001 Chain 2), lx) SEQ ID NO:418 (XENP33002 Chain 2), lxi) SEQ ID NO:419 (XENP33003 Chain 2), lxii) SEQ ID NO:420 (XENP33004 Chain 2), lxiii) SEQ ID NO:399 (XENP33005 Chain 2), lxiv) SEQ ID NO:400 (XENP33006 Chain 2), lxv) SEQ ID NO:401 (XENP33007 Chain 2), lxvi) SEQ ID NO:289 (XENP33008 Chain 2), lxvii) SEQ ID NO:289 (XENP33008 Chain 2), lxviii) SEQ ID NO:290 (XENP33009 Chain 2), lxix) SEQ ID NO:352 (XENP33010 Chain 2), and lxx) SEQ ID NO:354 (XENP33011 Chain 2).

In some embodiments, the present invention provides a heterodimeric Fc fusion protein, wherein said heterodimeric Fc fusion protein is selected from the group consisting of XENP27201, XENP28820, XENP28821, XENP28822, XENP28823, XENP28824, XENP28825, XENP28826, XENP28827, XENP28828, XENP28829, XENP28830, XENP28831, XENP28832, XENP28833, XENP28834, XENP28835, XENP28836, XENP28837, XENP28838, XENP28839, XENP28840, XENP28841, XENP28842, XENP28843, XENP28844, XENP28845, XENP28846, XENP28847, XENP28848, XENP28849, XENP28850, XENP28851, XENP28852, XENP29949, XENP29950, XENP29951, XENP29952, XENP30597, XENP30598, XENP30599, XENP30600, XENP30601, XENP30602, XENP30603, XENP30604, XENP30605, XENP30606. XENP30307, XENP30308, XENP30609, XENP31250, XENP31251, XENP31252, XENP31253, XENP31254, XENP31255, XENP31256, XENP31257, XENP31258, XENP31259, XENP31260, XENP31261, XENP31262, XENP31263, XENP31264, XENP31265, XENP31286, XENP31142, XENP31143, XENP31144, XENP31145, XENP31146, XENP31582, XENP31583, XENP31584, XENP32186, XENP32187, XENP32188, XENP32189, XENP32190, XENP32191, XENP32991, XENP32992, XENP32993, XENP32994, XENP32995, XENP32996, XENP32997, XENP32998, XENP32999, XENP33000, XENP33001, XENP33002, XENP33003, XENP33004, XENP33005, XENP33006, XENP33007, XENP33008, XENP33008, XENP33009, XENP33010, and XENP33011.

In some embodiments, the present invention provides a heterodimeric Fc fusion protein, wherein said heterodimeric Fc fusion protein is selected from the group consisting of: XENP31251, XENP31254, XENP31258, XENP32186, XENP32187, XENP32188, XENP32189, XENP32190, and XENP32191.

In some embodiments, the present invention provides a heterodimeric Fc fusion protein, further comprising one or more modifications to the IL-12p40 subunit selected from the group consisting of: N103Q, N113Q, N200Q, and N281Q.

In some embodiments, the present invention provides a composition comprising a heterodimeric Fc fusion protein for use in treating cancer in a subject.

In some embodiments, the present invention provides one or more nucleic acids encoding a heterodimeric Fc fusion protein.

In some embodiments, the present invention provides a host cell comprising said one or more nucleic acids encoding a heterodimeric Fc fusion protein.

In some embodiments, the present invention provides a method of making a heterodimeric Fc fusion protein, said method comprising culturing a host cell under conditions whereby said heterodimeric Fc fusion protein is produced.

In some embodiments, the present invention provides a method of purifying a heterodimeric Fc fusion protein, said method comprising: a) providing a composition comprising the heterodimeric Fc fusion protein; b) loading said composition onto an ion exchange column; and c) collecting a fraction containing said heterodimeric Fc fusion protein.

In some embodiments, the present invention provides a heterodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299.

In some embodiments, the present invention provides a heterodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In another aspect, the present invention provides a heterodimeric Fc fusion protein comprising: a) a first fusion protein comprising a first protein domain and a first Fc domain, wherein said first protein domain is covalently attached to the C-terminus of said first Fc domain; and b) a second fusion protein comprising a second protein domain and a second Fc domain, wherein said second protein domain is covalently attached to the C-terminus of said Fc domain; wherein said first and said second Fc domains comprise modifications promoting heterodimerization of said first and said second Fc domains and wherein said first protein domain comprises an IL-12p40 subunit and said second protein domain comprises an IL-12p35 subunit.

In some embodiments, the present invention provides a heterodimeric Fc fusion protein wherein said modifications promoting heterodimerization of said first and said second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V:T366W (optionally including a bridging disulfide, T366S/L368A/Y407V/Y349C:T366W/S354C), according to EU numbering.

In some embodiments, the present invention provides a heterodimeric Fc fusion protein wherein said first protein domain is attached to said first Fc domain using a first domain linker and/or said second protein domain is attached to said second Fc domain using a second domain linker.

In some embodiments, the present invention provides a heterodimeric Fc fusion protein wherein said first and/or said second Fc domains have an additional set of amino acid substitutions comprising Q295E/N384D/Q418E/N421D, according to EU numbering.

In some embodiments, the present invention provides a heterodimeric Fc fusion protein wherein said first and/or said second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a heterodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and/or said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric Fc fusion protein wherein said first and second Fc domains further comprise amino acid substitutions M428L/N424S.

In some embodiments, the present invention provides a heterodimeric Fc fusion protein wherein said IL-12p40 subunit is a variant IL-12p40 subunit and/or said IL-12p35 subunit is a variant IL-12p35 subunit.

In some embodiments, the present invention provides a heterodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299.

In some embodiments, the present invention provides a heterodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/

K99E/C252S, D18K/E59K/K99E/C252S/K264E, E59K/ K99Y/C252S, E59K/K99E/C252S/K264E, E59K/K99E/ C252S, N103D/N113D, N103D/N200D, N103D/N281D, N113D/N200D, N113D/N281D, N200D/N281D, N103D/ N113D/N200D, N103D/N113D/N281D, N103D/N200D/ N281D, N113D/N200D/N281D, N103Q/N113Q, N103Q/ N200Q, N103Q/N281Q, N113Q/N200Q, N113Q/N281Q, N200Q/N281Q, N103Q/N113Q/N200Q, N103Q/N113Q/ N281Q, N103Q/N200Q/N281Q, N113Q/N200Q/N281Q, N103Q/N113Q/N200Q/N281Q, E59K/K99E/N103Q/ C252S/K264E, E59K/K99E/N113Q/C252S/K264E, E59K/ K99E/N200Q/C252S/K264E, E59K/K99E/N281Q/C252S/ K264E, E59K/K99E/N103Q/N113Q/C252S/K264E, E59K/ K99E/N103Q/N200Q/C252S/K264E, E59K/K99E/N103Q/ N281Q/C252S/K264E, E59K/K99E/N113Q/N200Q/ C252S/K264E, E59K/K99E/N113Q/N281Q/C252S/K264E, E59K/K99E/N200Q/N281Q/C252S/K264E, E59K/K99E/ N103Q/N113Q/N200Q/C252S/K264E, E59K/K99E/ N103Q/N200Q/N281Q/C252S/K264E, E59K/K99E/ N113Q/N200Q/N281Q/C252S/K264E, and E59K/K99E/ N113Q/N113Q/N200Q/N281Q/C252S/K264E.

In some embodiments, the present invention provides a heterodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/ E59K/K99E, D34K/E59K/K99E, E32Q/D34N/E59K/ K99E, E32K/D34N/E59K/K99E, D34N/E59Q, E59Q/ E187Q, S43E/E59Q, S43K/E49Q, E59Q/K163E, E59Q/ K99E, E59Q/K258E, E59Q/K260E, E59K/K99E, D18K/ E59K/K99E, E59K/K99E/K264E, E59K/K99Y, E59Y/ K99Y, E59Y/K99E, E45K/E59K/K99E, E59K/K99E/ Q144E, E59K/K99E/Q144K, E59K/K99E/R159E, E59K/ K99E/K264E, D18K/E59K/K99E/K264E, D18K/E59K/ K99E/C252S, D18K/E59K/K99E/C252S/K264E, E59K/ K99Y/C252S, E59K/K99E/C252S/K264E, E59K/K99E/ C252S, N103D/N113D, N103D/N200D, N103D/N281D, N113D/N200D, N113D/N281D, N200D/N281D, N103D/ N113D/N200D, N103D/N113D/N281D, N103D/N200D/ N281D, N113D/N200D/N281D, N103Q/N113Q, N103Q/ N200Q, N103Q/N281Q, N113Q/N200Q, N113Q/N281Q, N200Q/N281Q, N103Q/N113Q/N200Q, N103Q/N113Q/ N281Q, N103Q/N200Q/N281Q, N113Q/N200Q/N281Q, N103Q/N113Q/N200Q/N281Q, E59K/K99E/N103Q/ C252S/K264E, E59K/K99E/N113Q/C252S/K264E, E59K/ K99E/N200Q/C252S/K264E, E59K/K99E/N281Q/C252S/ K264E, E59K/K99E/N103Q/N113Q/C252S/K264E, E59K/ K99E/N103Q/N200Q/C252S/K264E, E59K/K99E/N103Q/ N281Q/C252S/K264E, E59K/K99E/N113Q/N200Q/ C252S/K264E, E59K/K99E/N113Q/N281Q/C252S/K264E, E59K/K99E/N200Q/N281Q/C252S/K264E, E59K/K99E/ N103Q/N113Q/N200Q/C252S/K264E, E59K/K99E/ N103Q/N200Q/N281Q/C252S/K264E, E59K/K99E/ N113Q/N200Q/N281Q/C252S/K264E, and E59K/K99E/ N103Q/N113Q/N200Q/N281Q/C252S/K264E.

In some embodiments, the present invention provides a heterodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40 (N281D)), v) SEQ ID NO:61 (IL-12p40(N103D/N113D/ N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40 (E45Q/Q56E)), xiii) SEQ ID NO:69 (IL-12p40(Q42E/ E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40 (D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40 (Q256N)), xxvii) SEQ ID NO:83 (IL-12p40(E299Q)), xxviii) SEQ ID NO:84 (IL-12p40(D87N)), xxix) IL-12p40 (E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/ K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/ E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40 (E59Q/K163E)), xlvi) SEQ ID NO:212 (IL-12p40(E59Q/ K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/ E59K/K99E)), lvi) SEQ ID NO: 340 (IL-12p40 (E59K/ K99E/Q144E)), lvii) SEQ ID NO: 341 (IL-12p40 (E59K/ K99E/Q144K)), lviii) SEQ ID NO: 342 (IL-12p40 (E59K/ K99E/R159E)), lix) SEQ ID NO: 343 (IL-12p40 (E59K/ K99E/K264E)), lx) SEQ ID NO: 344 (IL-12p40 (D18K/ E59K/K99E/K264E)), lxi) SEQ ID NO: 360 (IL-12p40 (C252S)), lxii) SEQ ID NO: 361 (IL-12p40 (D18K/E59K/ K99E/C252S)), lxiii) SEQ ID NO: 362 (IL-12p40 (D18K/ E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/ N200Q)), lxxxviii) SEQ ID NO: 275 (IL-12p40 (N103Q/

N113Q/N281Q)), lxxxix) SEQ ID NO: 276 (IL-12p40 (N103Q/N200N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)). In some embodiments, the present invention provides a heterodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a heterodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a heterodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35(D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L9A)), xxxvi) SEQ ID NO: 348 (IL-12p35(L124A)), xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a heterodimeric Fc fusion protein wherein said heterodimeric Fc fusion protein comprises: a) said first fusion protein having a polypeptide sequence of SEQ ID NO:49 (XENP27202 Chain 1), and b) said second fusion protein having a polypeptide sequence of SEQ ID NO:50 (XENP27202 Chain 2).

In some embodiments, the present invention provides a heterodimeric Fc fusion protein wherein said heterodimeric Fc fusion protein is XENP27202.

In some embodiments, the present invention provides a composition comprising a heterodimeric Fc fusion protein for use in treating cancer in a subject.

In some embodiments, the present invention provides one or more nucleic acids encoding a heterodimeric Fc fusion protein.

In some embodiments, the present invention provides a host cell comprising said one or more nucleic acids encoding a heterodimeric Fc fusion protein.

In some embodiments, the present invention provides a method of making a heterodimeric Fc fusion protein, said method comprising culturing a host cell under conditions whereby said heterodimeric Fc fusion protein is produced.

In some embodiments, the present invention provides a method of purifying a heterodimeric Fc fusion protein, said method comprising: a) providing a composition comprising the heterodimeric Fc fusion protein; b) loading said composition onto an ion exchange column; and c) collecting a fraction containing said heterodimeric Fc fusion protein.

In another aspect, the present invention provides a heterodimeric Fc fusion protein comprising: a) a fusion protein comprising a first protein domain, a second protein domain and a first Fc domain, wherein said first protein domain is covalently attached to said second protein domain, and wherein said second protein domain is covalently attached to the N-terminus of said first Fc domain; and b) a second Fc domain; wherein said first and said second Fc domains comprise modifications promoting heterodimerization of said first and said second Fc domains and wherein said first protein domain comprises an IL-12p40 subunit and said second protein domain comprises an IL-12p35 subunit.

In some embodiments, the present invention provides a heterodimeric Fc fusion protein wherein said modifications promoting heterodimerization of said first and said second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V:T366W (optionally including a bridging disulfide, T366S/L368A/Y407V/Y349C:T366W/S354C), according to EU numbering.

In some embodiments, the present invention provides a heterodimeric Fc fusion protein wherein said first protein domain is attached to said second protein domain using a first domain linker and/or said second protein domain is attached to said first Fc domain using a second domain linker.

In some embodiments, the present invention provides a heterodimeric Fc fusion protein wherein said first and/or said second Fc domains have an additional set of amino acid substitutions comprising Q295E/N384D/Q418E/N421D, according to EU numbering.

In some embodiments, the present invention provides a heterodimeric Fc fusion protein wherein said first and/or said second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a heterodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and/or said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric Fc fusion protein wherein said first and second Fc domains further comprise amino acid substitutions M428L/N424S.

In some embodiments, the present invention provides a heterodimeric Fc fusion protein wherein said IL-12p40 subunit is a variant IL-12p40 subunit and/or said IL-12p35 subunit is a variant IL-12p35 subunit.

In some embodiments, the present invention provides a heterodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, D33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, Q256, K158, C252, K260, E262, K264, D265, D270, N281, Q289, D290, R291, Y292, Y293, and E299.

In some embodiments, the present invention provides a heterodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a heterodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64

(IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40 (D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40 (Q256N)), xxvii) SEQ ID NO:83 (IL-12p40(E299Q)), xxviii) SEQ ID NO:84 (IL-12p40(D87N)), xxix) IL-12p40 (E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40 (E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a heterodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a heterodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x)

SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/ E153Q)), xxv) SEQ ID NO:228 (IL-12p35(N151D/ D165N)), xxvi) SEQ ID NO:229 (IL-12p35(Q130E/ N151D)), xxvii) SEQ ID NO:230 (IL-12p35(N151D/ K158E)), xxviii) SEQ ID NO:231 (IL-12p35(E79Q/ N151D)), xxix) SEQ ID NO:232 (IL-12p35(D55Q/ N151D)), xxx) SEQ ID NO:233 (IL-12p35(N136D/ N151D)), xxxi) SEQ ID NO:234 (IL-12p35(N21D/ N151D)), xxxii) SEQ ID NO:235 (IL-12p35(E143Q/ N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/ N85Q)), xxxix) SEQ ID NO: 283 (IL-12p35 (N71Q/ N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a heterodimeric Fc fusion protein wherein said heterodimeric Fc fusion protein comprises: a) said fusion protein having a polypeptide sequence of SEQ ID NO:51 (XENP27203 Chain 1), and b) said second Fc domain having a polypeptide sequence of SEQ ID NO:52 (XENP27203 Chain 2).

In some embodiments, the present invention provides a heterodimeric Fc fusion protein wherein said heterodimeric Fc fusion protein is XENP27203.

In some embodiments, the present invention provides a heterodimeric Fc fusion protein wherein said heterodimeric Fc fusion protein is XENP31290.

In some embodiments, the present invention provides a composition comprising a heterodimeric Fc fusion protein for use in treating cancer in a subject.

In some embodiments, the present invention provides one or more nucleic acids encoding a heterodimeric Fc fusion protein.

In some embodiments, the present invention provides a host cell comprising said one or more nucleic acids encoding a heterodimeric Fc fusion protein.

In some embodiments, the present invention provides a method of making a heterodimeric Fc fusion protein, said method comprising culturing a host cell under conditions whereby said heterodimeric Fc fusion protein is produced.

In some embodiments, the present invention provides a method of purifying a heterodimeric Fc fusion protein, said method comprising: a) providing a composition comprising the heterodimeric Fc fusion protein; b) loading said composition onto an ion exchange column; and c) collecting a fraction containing said heterodimeric Fc fusion protein.

In another aspect, the present invention provides a heterodimeric Fc fusion protein comprising: a) a fusion protein comprising a first protein domain, a second protein domain and a first Fc domain, wherein said first protein domain is covalently attached to said second protein domain, and wherein said second protein domain is covalently attached to the N-terminus of said first Fc domain; and b) a second Fc domain; wherein said first and said second Fc domains comprise modifications promoting heterodimerization of said first and said second Fc domains and wherein said first protein domain comprises an IL-12p35 subunit and said second protein domain comprises an IL-12p40 subunit.

In some embodiments, the present invention provides a heterodimeric Fc fusion protein wherein said modifications promoting heterodimerization of said first and said second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/ K370S and S364K; K370S and S364K/E357Q and T366S/ L368A/Y407V:T366W (optionally including a bridging disulfide, T366S/L368A/Y407V/Y349C:T366W/S354C), according to EU numbering.

In some embodiments, the present invention provides a heterodimeric Fc fusion protein wherein said first protein domain is attached to said second protein domain using a first domain linker and/or said second protein domain is attached to said first Fc domain using a second domain linker.

In some embodiments, the present invention provides a heterodimeric Fc fusion protein wherein said first and/or said second Fc domains have an additional set of amino acid substitutions comprising Q295E/N384D/Q418E/N421 D, according to EU numbering.

In some embodiments, the present invention provides a heterodimeric Fc fusion protein wherein said first and/or said second Fc domains have an additional set of amino acid substitutions selected from the group consisting of G236R/ L328R, E233P/L234V/L235A/G236_/S239K, E233P/ L234V/L235A/G236_/S239K/A327G, E233P/L234V/ L235A/G236_/S267K/A327G, E233P/L234V/L235A/ G236_, and E233P/L234V/L235A/G236_/S267K, according to EU numbering.

In some embodiments, the present invention provides a heterodimeric Fc fusion protein wherein said IL-12p40 subunit has a polypeptide sequence selected form the group consisting of SEQ ID NO:3 (human IL-12 subunit beta (IL-12p40) precursor sequence) and/or SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric Fc fusion protein wherein said first and second Fc domains further comprise amino acid substitutions M428L/N424S.

In some embodiments, the present invention provides a heterodimeric Fc fusion protein wherein said IL-12p40 subunit is a variant IL-12p40 subunit and/or said IL-12p35 subunit is a variant IL-12p35 subunit.

In some embodiments, the present invention provides a heterodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299.

In some embodiments, the present invention provides a heterodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/C252S/K264E.

In some embodiments, the present invention provides a heterodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40(E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a heterodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a heterodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35(D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D)), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a heterodimeric Fc fusion protein wherein said heterodimeric Fc fusion protein comprises: a) said fusion protein having a polypeptide sequence of SEQ ID NO:53 (XENP27204 Chain 1), and b) said second Fc domain having a polypeptide sequence of SEQ ID NO:54 (XENP27204 Chain 2).

In some embodiments, the present invention provides a heterodimeric Fc fusion protein wherein said heterodimeric Fc fusion protein is XENP27204.

In some embodiments, the present invention provides a composition comprising a heterodimeric Fc fusion protein for use in treating cancer in a subject.

In some embodiments, the present invention provides one or more nucleic acids encoding a heterodimeric Fc fusion protein.

In some embodiments, the present invention provides a host cell comprising said one or more nucleic acids encoding a heterodimeric Fc fusion protein.

In some embodiments, the present invention provides a method of making a heterodimeric Fc fusion protein, said method comprising culturing a host cell under conditions whereby said heterodimeric Fc fusion protein is produced.

In some embodiments, the present invention provides a method of purifying a heterodimeric Fc fusion protein, said method comprising: a) providing a composition comprising the heterodimeric Fc fusion protein; b) loading said composition onto an ion exchange column; and c) collecting a fraction containing said heterodimeric Fc fusion protein.

In another aspect, the present invention provides a heterodimeric Fc fusion protein comprising: a) a fusion protein comprising a first protein domain, a second protein domain and a first Fc domain, wherein said first protein domain is attached to the C-terminus of said first Fc domain, and wherein said second protein domain is covalently attached to said first protein domain; and b) a second Fc domain; wherein said first and said second Fc domains comprise modifications promoting heterodimerization of said first and said second Fc domains and wherein said first protein domain comprises an IL-12p40 subunit and said second protein domain comprises an IL-12p35 subunit.

In some embodiments, the present invention provides a heterodimeric Fc fusion protein wherein said modifications promoting heterodimerization of said first and said second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V:T366W (optionally including a bridging disulfide, T366S/L368A/Y407V/Y349C:T366W/S354C), according to EU numbering.

In some embodiments, the present invention provides a heterodimeric Fc fusion protein wherein said first protein domain is attached to said second protein domain using a first domain linker and/or said second protein domain is attached to said first Fc domain using a second domain linker.

In some embodiments, the present invention provides a heterodimeric Fc fusion protein wherein said first and/or said second Fc domains have an additional set of amino acid substitutions comprising Q295E/N384D/Q418E/N421 D, according to EU numbering.

In some embodiments, the present invention provides a heterodimeric Fc fusion protein wherein said first and/or said second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a heterodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and/or said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric Fc fusion protein wherein said first and second Fc domains further comprise amino acid substitutions M428L/N424S.

In some embodiments, the present invention provides a heterodimeric Fc fusion protein wherein said IL-12p40 subunit is a variant IL-12p40 subunit and/or said IL-12p35 subunit is a variant IL-12p35 subunit.

In some embodiments, the present invention provides a heterodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299.

In some embodiments, the present invention provides a heterodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a heterodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40(E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q, xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO: 377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a heterodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a heterodimeric Fc fusion protein wherein said IL-12p35 subunit has a polypeptide sequence selected from the group consisting of: i) SEQ ID NO:113 (IL-12p35(N71D)), ii)

SEQ ID NO:114 (IL-12p35(N85D)), iii) SEQ ID NO:115 (IL-12p35(N195D)), iv) SEQ ID NO:116 (IL-12p35(N71D/ N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/ E153Q)), xxv) SEQ ID NO:228 (IL-12p35(N151D/ D165N)), xxvi) SEQ ID NO:229 (IL-12p35(Q130E/ N151D)), xxvii) SEQ ID NO:230 (IL-12p35(N151D/ K158E)), xxviii) SEQ ID NO:231 (IL-12p35(E79Q/ N151D)), xxix) SEQ ID NO:232 (IL-12p35(D55Q/ N151D)), xxx) SEQ ID NO:233 (IL-12p35(N136D/ N151D)), xxxi) SEQ ID NO:234 (IL-12p35(N21D/ N151D)), xxxii) SEQ ID NO:235 (IL-12p35(E143Q/ N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/ N85Q)), xxxix) SEQ ID NO: 283 (IL-12p35 (N71Q/ N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a composition comprising a heterodimeric Fc fusion protein for use in treating cancer in a subject.

In some embodiments, the present invention provides one or more nucleic acids encoding a heterodimeric Fc fusion protein.

In some embodiments, the present invention provides a host cell comprising said one or more nucleic acids encoding a heterodimeric Fc fusion protein.

In some embodiments, the present invention provides a method of making a heterodimeric Fc fusion protein, said method comprising culturing a host cell under conditions whereby said heterodimeric Fc fusion protein is produced.

In some embodiments, the present invention provides a method of purifying a heterodimeric Fc fusion protein, said method comprising: a) providing a composition comprising the heterodimeric Fc fusion protein; b) loading said composition onto an ion exchange column; and c) collecting a fraction containing said heterodimeric Fc fusion protein.

In another aspect, the present invention provides a heterodimeric Fc fusion protein comprising: a) a fusion protein comprising a first protein domain, a second protein domain and a first Fc domain, wherein said first protein domain is attached to the C-terminus of said first Fc domain, and wherein said second protein domain is covalently attached to said first protein domain; and b) a second Fc domain; wherein said first and said second Fc domains comprise modifications promoting heterodimerization of said first and said second Fc domains and wherein said first protein domain comprises an IL-12p35 subunit and said second protein domain comprises an IL-12p40 subunit.

In some embodiments, the present invention provides a heterodimeric Fc fusion protein, wherein said modifications promoting heterodimerization of said first and said second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/ K370S and S364K; K370S and S364K/E357Q and T366S/ L368A/Y407V:T366W (optionally including a bridging disulfide, T366S/L368A/Y407V/Y349C:T366W/S354C), according to EU numbering.

In some embodiments, the present invention provides a heterodimeric Fc fusion protein wherein said first protein domain is attached to said second protein domain using a first domain linker and/or said second protein domain is attached to said first Fc domain using a second domain linker.

In some embodiments, the present invention provides a heterodimeric Fc fusion protein wherein said first and/or said second Fc domains have an additional set of amino acid substitutions comprising Q295E/N384D/Q418E/N421D, according to EU numbering.

In some embodiments, the present invention provides a heterodimeric Fc fusion protein wherein said first and/or said second Fc domains have an additional set of amino acid substitutions selected from the group consisting of G236R/ L328R, E233P/L234V/L235A/G236_/S239K, E233P/ L234V/L235A/G236_/S239K/A327G, E233P/L234V/ L235A/G236_/S267K/A327G, E233P/L234V/L235A/ G236_, and E233P/L234V/L235A/G236_/S267K, according to EU numbering.

In some embodiments, the present invention provides a heterodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and/ or said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric Fc fusion protein wherein said first and second Fc domains further comprise amino acid substitutions M428L/N424S.

In some embodiments, the present invention provides a heterodimeric Fc fusion protein wherein said IL-12p40 subunit is a variant IL-12p40 subunit and/or said IL-12p35 subunit is a variant IL-12p35 subunit.

In some embodiments, the present invention provides a heterodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299.

In some embodiments, the present invention provides a heterodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a heterodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40(E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/

N113Q/N281Q)), lxxxix) SEQ ID NO: 276 (IL-12p40 (N103Q/N200N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a heterodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a heterodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L9A)), xxxvi) SEQ ID NO: 348 (IL-12p35(L124A)), xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a composition comprising a heterodimeric Fc fusion protein for use in treating cancer in a subject.

In some embodiments, the present invention provides one or more nucleic acids encoding a heterodimeric Fc fusion protein.

In some embodiments, the present invention provides a host cell comprising said one or more nucleic acids encoding a heterodimeric Fc fusion protein.

In some embodiments, the present invention provides a method of making a heterodimeric Fc fusion protein, said method comprising culturing a host cell under conditions whereby said heterodimeric Fc fusion protein is produced.

In some embodiments, the present invention provides a method of purifying a heterodimeric Fc fusion protein, said method comprising: a) providing a composition comprising the heterodimeric Fc fusion protein; b) loading said composition onto an ion exchange column; and c) collecting a fraction containing said heterodimeric Fc fusion protein.

In another aspect, the present invention provides a heterodimeric complex comprising: a) an IL-12p40 subunit, and b) an IL-12p35 subunit.

In some embodiments, the present invention provides a heterodimeric complex wherein said IL-12p40 subunit is covalently attached to said IL-12p35 subunit using domain linker.

In some embodiments, the present invention provides a heterodimeric complex wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and/or said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a heterodimeric complex wherein said first and second Fc domains further comprise amino acid substitutions M428L/ N424S.

In some embodiments, the present invention provides a heterodimeric complex wherein said IL-12p40 subunit is a variant IL-12p40 subunit and/or said IL-12p35 subunit is a variant IL-12p35 subunit.

In some embodiments, the present invention provides a heterodimeric complex wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a heterodimeric complex wherein said IL-12p40 subunit has one or more amino acid modifications at amino acid residues selected from the group consisting of: E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299.

In some embodiments, the present invention provides a heterodimeric complex wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a heterodimeric complex wherein said IL-12p40 subunit has amino acid substitutions selected from the group consisting of N103D/N13D/N200D/N281D, Q42E/E45Q, E45Q/ Q56E, Q42E/E59Q, Q56E/E59Q, Q42E/E45Q/Q56E, E45Q/Q56E/E59Q, E32Q/E59Q, D34N/E59K, D34N/ E59K/K99E, D34K/E59K/K99E, E32Q/D34N/E59K/ K99E, E32K/D34N/E59K/K99E, D34N/E59Q, E59Q/ E187Q, S43E/E59Q, S43K/E49Q, E59Q/K163E, E59Q/ K99E, E59Q/K258E, E59Q/K260E, E59K/K99E, D18K/ E59K/K99E, E59K/K99E/K264E, E59K/K99Y, E59Y/ K99Y, E59Y/K99E, E45K/E59K/K99E, E59K/K99E/ Q144E, E59K/K99E/Q144K, E59K/K99E/R159E, E59K/ K99E/K264E, D18K/E59K/K99E/K264E, D18K/E59K/ K99E/C252S, D18K/E59K/K99E/C252S/K264E, E59K/ K99Y/C252S, E59K/K99E/C252S/K264E, E59K/K99E/ C252S, N103D/N113D, N103D/N200D, N103D/N281D, N113D/N200D, N113D/N281D, N200D/N281D, N103D/ N113D/N200D, N113D/N200D/N281D, N103D/N200D/ N281D, N113D/N200D/N281D, N103Q/N113Q, N103Q/ N200Q, N103Q/N281Q, N113Q/N200Q, N113Q/N281Q, N200Q/N281Q, N103Q/N113Q/N200Q, N103Q/N113Q/ N281Q, N103Q/N200Q/N281Q, N113Q/N200Q/N281Q, N103Q/N113Q/N200Q/N281Q, E59K/K99E/N103Q/ C252S/K264E, E59K/K99E/N113Q/C252S/K264E, E59K/ K99E/N200Q/C252S/K264E, E59K/K99E/N281Q/C252S/ K264E, E59K/K99E/N103Q/N113Q/C252S/K264E, E59K/ K99E/N103Q/N200Q/C252S/K264E, E59K/K99E/N103Q/ N281Q/C252S/K264E, E59K/K99E/N113Q/N200Q/ C252S/K264E, E59K/K99E/N113Q/N281Q/C252S/K264E, E59K/K99E/N200Q/N281Q/C252S/K264E, E59K/K99E/ N103Q/N113Q/N200Q/C252S/K264E, E59K/K99E/ N103Q/N200Q/N281Q/C252S/K264E, E59K/K99E/ N113Q/N200Q/N281Q/C252S/K264E, and E59K/K99E/ N103Q/N113Q/N200Q/N281Q/C252S/K264E.

In some embodiments, the present invention provides a heterodimeric complex wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40 (N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/ E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40 (E45Q/Q56E/E59Q)), xvii) SEQ ID NO:73 (IL-12p40 (D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40 (E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40 (E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40 (D34N), xxxi) IL-12p40(S43E), xxxii) IL-12p40(S43K), xxxiii) SEQ ID NO:379 (IL-12p40 (E59K/K99E/N103Q/ N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/ E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/ E59K/K99E)), lii) SEQ ID NO: 343 (IL-12p40 (E59K/ K99E/K264E)), liii) SEQ ID NO: 336 (IL-12p40 (E59K/ K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric complex wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a heterodimeric complex wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a heterodimeric complex wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a heterodimeric complex wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35 (N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35 (N76D)), xii) SEQ ID NO:124 (IL-12p35(E162Q)), xiii) SEQ ID NO:125 (IL-12p35(E163Q)), xiv) IL-12p35 (N21D), xv) SEQ ID NO:333 (IL-12p35(D55Q)), xvi) IL-12p35(E79Q), xvii) IL-12p35(Q130E), xviii) IL-12p35 (N136D), xix) IL-12p35(E143Q), xx) SEQ ID NO:227 (IL-12p35(N151K)), xxi) SEQ ID NO:226 (IL-12p35 (E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D)), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a composition comprising a heterodimeric complex for use in treating cancer in a subject.

In some embodiments, the present invention provides one or more nucleic acids encoding a heterodimeric complex.

In some embodiments, the present invention provides a host cell comprising said one or more nucleic acids encoding a heterodimeric complex.

In some embodiments, the present invention provides a method of making a heterodimeric complex, said method comprising culturing a host cell under conditions whereby said heterodimeric complex is produced.

In some embodiments, the present invention provides a method of purifying a heterodimeric complex, said method comprising: a) providing a composition comprising the heterodimeric complex; b) loading said composition onto an ion exchange column; and c) collecting a fraction containing said heterodimeric complex.

In another aspect, the present invention provides a variant IL-12p40 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a variant IL-12p40 subunit wherein said variant IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, 189, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, Q256, C252, K258, K260, E262, K264, D265, D270, N281, Q289, D290, R291, Y292, Y293, and E299.

In some embodiments, the present invention provides a variant IL-12p40 subunit wherein said variant IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a variant IL-12p40 subunit wherein said variant IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a variant IL-12p40 subunit wherein said variant IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40(E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL- 12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a composition comprising a variant IL-12p40 subunit.

In some embodiments, the present invention provides a nucleic acid encoding a variant IL-12p40 subunit.

In some embodiments, the present invention provides a host cell comprising said nucleic acid encoding a variant IL-12p40 subunit.

In some embodiments, the present invention provides a method of making a variant IL-12p40 subunit, said method comprising culturing a host cell according to claim H8 under conditions whereby said variant IL-12p40 subunit is produced.

In another aspect, the present invention provides a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a variant IL-12p35 subunit, wherein said variant IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I1171, R181, I1182, R183, V185, T186, D188, R189, V190, S192, Y193, N195, and A196.

In some embodiments, the present invention provides a variant IL-12p35 subunit, wherein said variant IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a variant IL-12p35 subunit, wherein said variant IL-12p35 subunit amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a variant IL-12p35 subunit, wherein said variant IL-12p35 subunit has amino acid substitutions N71D/N85D/N195D.

In some embodiments, the present invention provides a variant IL-12p35 subunit wherein said variant IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L9A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a composition comprising a variant IL-12p35 subunit.

In some embodiments, the present invention provides a nucleic acid encoding a variant IL-12p35 subunit.

In some embodiments, the present invention provides a host cell comprising said nucleic acid encoding a variant IL-12p35 subunit.

In some embodiments, the present invention provides a variant IL-12p35 subunit, said method comprising culturing a host cell under conditions whereby said variant IL-12p35 subunit is produced.

In another aspect, the present invention provides a heterodimeric protein comprising: a) a first fusion protein comprising an IL-12p40 subunit domain covalently attached to a first Fc domain; and b) a second fusion protein comprising an IL-12p35 subunit domain covalent attached to a second Fc domain; wherein said first and second Fc domains a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C; according to EU numbering.

In some embodiments, the present invention provides a heterodimeric protein, wherein said IL-12p40 subunit domain is attached N-terminal to said first Fc domain and said IL-12p35 subunit domain is attached N-terminal to said second Fc domain.

In some embodiments, the present invention provides a heterodimeric protein, wherein said IL-12p40 subunit domain is attached C-terminal to said first Fc domain and said IL-12p35 subunit domain is attached C-terminal to said second Fc domain.

In some embodiments, the present invention provides a heterodimeric protein, wherein said I1-12p40 subunit domain is attached to said first Fc domain using a domain linker and said IL-12p35 subunit domain is attached to said second Fc domain using a domain linker.

In some embodiments, the present invention provides a heterodimeric protein wherein said first and second Fc domain comprises the IgG1 hinge-CH2-CH3.

In some embodiments, the present invention provides a heterodimeric protein, wherein said first fusion protein comprises, from N- to C-terminal, an IL-12p40 subunit domain-domain linker-hinge-CH2-CH3 and said second fusion protein comprises, from N- to C-terminal, an IL-12p35 subunit domain-domain linker-hinge-CH2-CH3.

In some embodiments, the present invention provides a heterodimeric protein, wherein said first fusion protein comprises, from N- to C-terminal, hinge-CH2-CH3-domain linker-IL-12p40 subunit domain and said second fusion protein comprises, from N- to C-terminal, hinge-CH2-CH3-domain linker-IL-12p35 subunit domain.

In some embodiments, the present invention provides a heterodimeric protein wherein said IL-12p40 subunit has a sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40 (E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40 (D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328

(IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric protein wherein said IL-12p35 subunit has a sequence selected from the group consisting of: i) SEQ ID NO:113 (IL-12p35(N71D)), ii) SEQ ID NO:114 (IL-12p35 (N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35 (E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35 (E143Q), xx) SEQ ID NO:227 (IL-12p35(N151K)), xxi) SEQ ID NO:226 (IL-12p35(E153K)), xxii) (IL-12p35 (K158E)), xxiii) IL-12p35(D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35 (Q130E/N151D)), xxvii) SEQ ID NO:230 (IL-12p35 (N151D/K158E)), xxviii) SEQ ID NO:231 (IL-12p35 (E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)),xxxiii) SEQ ID NO: 345 (IL-12p35 (F96A)),xxxiv) SEQ ID NO: 346 (IL-12p35(M97A)), xxxv) SEQ ID NO: 347 (IL-12p35(L9A)),xxxvi) SEQ ID NO: 348 (IL-12p35 (L124A)),xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)),xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)),xxxix) SEQ ID NO: 283 (IL-12p35 (N71Q/N195Q)),lx) SEQ ID NO: 284 (IL-12p35 (N85Q/N195Q),lxi) SEQ ID NO: 285 (IL-12p35 (N71Q/N85Q/N195Q)),lxii) SEQ ID NO: 286 (IL-12p35 (N71D/N85D)), lxiii) SEQ ID NO: 287 (IL-12p35 (N71D/N195D),lxiv) SEQ ID NO: 288 (IL-12p35 (N85D/N195D)), lxv) SEQ ID NO: 333 (IL-12p35 (D55Q)), and lxvi) SEQ ID NO: 334 (IL-12p35 (D55K)).

In another aspect, the present invention comprises a heterodimeric protein comprising: a) a first Fc domain; and b) a fusion protein comprising: i) a second Fc domain; ii) an IL-12p40 subunit domain; and iii) an IL-12p35 subunit domain; wherein said first and second Fc domains a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C; according to EU numbering.

In some embodiments, the present invention provides a heterodimeric protein wherein said fusion protein comprises, from N- to C-terminal: IL-12p40 subunit domain-domain linker-IL-12p35 subunit domain-domain linker-hinge-CH2-CH3.

In some embodiments, the present invention provides a heterodimeric protein wherein said fusion protein comprises, from N- to C-terminal: IL-12p35 subunit domain-domain linker-IL-12p40 subunit domain-domain linker-hinge-CH2-CH3.

In some embodiments, the present invention provides a heterodimeric protein wherein said fusion protein comprises, from N- to C-terminal: hinge-CH2-CH3-domain linker-IL-12p35 subunit domain-domain linker-IL-12p40 subunit domain.

In some embodiments, the present invention provides a heterodimeric protein wherein said fusion protein comprises, from N- to C-terminal: hinge-CH2-CH3-domain linker-IL-12p40 subunit domain-domain linker-IL-12p35 subunit domain.

In some embodiments, the present invention provides a heterodimeric protein wherein said IL-12p40 subunit has a sequence selected from the group consisting of: i) SEQ ID NO:57 (IL-12p40(N103D)), ii) SEQ ID NO:58 (IL-12p40 (N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40 (Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40 (E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40 (Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40 (D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214

(IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N3D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a heterodimeric protein wherein said IL-12p35 subunit has a sequence selected from the group consisting of: i) SEQ ID NO:113 (IL-12p35(N71D)), ii) SEQ ID NO:114 (IL-12p35 (N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35 (E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35 (E143Q), xx) SEQ ID NO:227 (IL-12p35(N151K)), xxi) SEQ ID NO:226 (IL-12p35(E153K)), xxii) IL-12p35 (K158E), xxiii) IL-12p35(D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35 (Q130E/N151D)), xxvii) SEQ ID NO:230 (IL-12p35 (N151D/K158E)), xxviii) SEQ ID NO:231 (IL-12p35 (E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)),xxxiii) SEQ ID NO: 345 (IL-12p35(F96A)),xxxiv) SEQ ID NO: 346 (IL-12p35(M97A)), xxxv) SEQ ID NO: 347 (IL-12p35(L89A)),xxxvi) SEQ ID NO: 348 (IL-12p35 (L124A)),xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)),xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)),xxxix) SEQ ID NO: 283 (IL-12p35 (N71Q/N195Q)),lx) SEQ ID NO: 284 (IL-12p35 (N85Q/N195Q),lxi) SEQ ID NO: 285 (IL-12p35 (N71Q/N85Q/N195Q)),lxii) SEQ ID NO: 286 (IL-12p3$^5$ (N71D/N85D)), lxiii) SEQ ID NO: 287 (IL-12p35 (N71D/N195D),lxiv) SEQ ID NO: 288 (IL-12p3$^5$ (N85D/N195D)), lxv) SEQ ID NO: 333 (IL-12p35 (D55Q)), and lxvi) SEQ ID NO: 334 (IL-12p35 (D55K)).

In another aspect, the present invention provides a homodimeric Fc fusion protein comprising a first monomer and a second monomer each comprising, from N- to C-terminal, an IL-12p40 subunit domain—an optional first domain linker—an IL-12p35 subunit domain—an optional second domain linker—an Fc domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO: 3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a homodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40(E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO:

325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of Q20, N21, Q35, E38, 544, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q), xlii) SEQ ID NO: 286 (IL-12p35 (N71D/N85D)), xliii) SEQ ID NO: 287 (IL-12p35 (N71D/N195D), xliv) SEQ ID NO:

288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, an IL-12p35 subunit domain—an optional first domain linker—an IL-12p40 subunit domain—an optional second domain linker—an Fc domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a homodimeric Fc fusion protein wherein said IL-12p40 subunit has amino acid substitutions selected from the group consisting of N103D/N13D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of:

i) SEQ ID NO:57 (IL-12p40(N103D)), ii) SEQ ID NO:58 (IL-12p40(N113D)), iii) SEQ ID NO:59 (IL-12p40 (N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40 (E45Q/Q56E/E59Q)), xvii) SEQ ID NO:73 (IL-12p40 (D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40 (E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40 (E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40 (D34N), xxxi) IL-12p40(S43E), xxxii) IL-12p40(S43K), xxxiii) SEQ ID NO:379 (IL-12p40 (E59K/K99E/N103Q/N103Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35(D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q)), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D)), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, an Fc domain—an optional first domain linker—an IL-12p40 subunit domain—an optional second domain linker—an IL-12p35 subunit domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a homodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N113Q/N281Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40(E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL- 12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of: Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, an Fc domain—an optional first domain linker—an IL-12p35 subunit domain—an optional second domain linker—an IL-12p40 subunit domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q C252S, Q256N, K258E, K260E, E262Q, K264E, N281D, N281(Q, and E299Q.

In some embodiments, the present invention provides a homodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K1E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N113Q/N200Q, N103Q/N281Q, N113Q/N200Q, N113Q/N281Q, N200Q/N281Q, N113Q/N113Q/N200Q, N103Q/N113Q/N281Q, N103Q/N200Q/N281Q, N113Q/N200Q/N281Q, N113Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N113Q/N281Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40

(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Y/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/ E153Q)), xxv) SEQ ID NO:228 (IL-12p35(N151D/ D165N)), xxvi) SEQ ID NO:229 (IL-12p35(Q130E/ N151D)), xxvii) SEQ ID NO:230 (IL-12p35(N151D/ K158E)), xxviii) SEQ ID NO:231 (IL-12p35(E79Q/ N151D)), xxix) SEQ ID NO:232 (IL-12p35(D55Q/ N151D)), xxx) SEQ ID NO:233 (IL-12p35(N136D/ N151D)), xxxi) SEQ ID NO:234 (IL-12p35(N21D/ N151D)), xxxii) SEQ ID NO:235 (IL-12p35(E143Q/ N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/ N85Q)), xxxix) SEQ ID NO: 283 (IL-12p35 (N71Q/ N195Q)), xl) SEQ ID NO: 284 (IL-12p35 (N85Q/N195Q)), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, an IL-12p40 subunit domain—a first domain linker— an IL-12p35 subunit domain—a second domain linker-Fc domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/ S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/ L235A/G236_/S239K, E233P/L234V/L235A/G236_/ S239K/A327G, E233P/L234V/L235A/G236_/S267K/ A327G, E233P/L234V/L235A/G236_, and E233P/L234V/ L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/ N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/ or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a homodimeric Fc fusion protein wherein said IL-12p40 subunit has amino acid substitutions selected from the group consisting of N103D/N13D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of:

i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N3D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200N2Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/

K264E)), cii) SEQ ID NO:371 (IL-12p40 (E59K/K99E/ N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/ C252S/K264E)), cv) SEQ ID NO:374 (IL-12p40 (E59K/ K99E/N113Q/N281Q/C252S/K264E)), cvi) SEQ ID NO:375 (IL-12p40 (E59K/K99E/N200Q/N281Q/C252S/ K264E)), cvii) SEQ ID NO:376 (IL-12p40 (E59K/K99E/ N103Q/N113Q/N200Q/C252S/K264E)), cviii) SEQ ID NO:377 (IL-12p40 (E59K/K99E/N103Q/N200Q/N281Q/ C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/ D165N, Q130E/N151D, N151D/K158E, E79Q/N151D, D55Q/N151D, N136D/N151D, N21D/N151D, E143Q/ N151D, N71Q/N85Q, N71Q/N195Q, N85Q/N195Q, N71Q/ N85Q/N195Q, N71D/N85D, N71D/N195D, and N85D/ N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/ N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/ E153Q)), xxv) SEQ ID NO:228 (IL-12p35(N151D/ D165N)), xxvi) SEQ ID NO:229 (IL-12p35(Q130E/ N151D)), xxvii) SEQ ID NO:230 (IL-12p35(N151D/ K158E)), xxviii) SEQ ID NO:231 (IL-12p35(E79Q/ N151D)), xxix) SEQ ID NO:232 (IL-12p35(D55Q/ N151D)), xxx) SEQ ID NO:233 (IL-12p35(N136D/ N151D)), xxxi) SEQ ID NO:234 (IL-12p35(N21D/ N151D)), xxxii) SEQ ID NO:235 (IL-12p35(E143Q/ N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L9A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/ N85Q)), xxxix) SEQ ID NO: 283 (IL-12p35 (N71Q/ N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, an IL-12p35 subunit domain—a first domain linker—an IL-12p40 subunit domain—a second domain linker-Fc domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/ S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200ID, N200Q, N218Q, Q229E, E235Q, C252S, Q256N, K258E, K260E, E262Q, K264E, N281D), N281Q, and E299Q.

In some embodiments, the present invention provides a homodimeric Fc fusion protein wherein said IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K1E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N113Q/N200Q, N103Q/N281Q, N113Q/N200Q, N113Q/N281Q, N200Q/N281Q, N113Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of:

i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL- 12p40 (D34N/E59K)), l) SEQ ID NO: 325 (IL-12p40 (E59K/K99E)), li) SEQ ID NO: 339 (IL-12p40(D18K/ E59K/K99E)), lii) SEQ ID NO: 343 (IL-12p40 (E59K/ K99E/K264E)), liii) SEQ ID NO: 336 (IL-12p40 (E59K/ K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/ N200Q)), lxxxviii) SEQ ID NO: 275 (IL-12p40 (N103Q/ N113Q/N281Q)), lxxxix) SEQ ID NO: 276 (IL-12p40 (N103Q/N200N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/ C252S/K264E)), xcix) SEQ ID NO:368 (IL-12p40 (E59K/ K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/ K264E)), cii) SEQ ID NO:371 (IL-12p40 (E59K/K99E/ N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/ C252S/K264E)), cv) SEQ ID NO:374 (IL-12p40 (E59K/ K99E/N113Q/N281Q/C252S/K264E)), cvi) SEQ ID NO:375 (IL-12p40 (E59K/K99E/N200Q/N281Q/C252S/ K264E)), cvii) SEQ ID NO:376 (IL-12p40 (E59K/K99E/ N103Q/N113Q/N200Q/C252S/K264E)), cviii) SEQ ID NO:377 (IL-12p40 (E59K/K99E/N103Q/N200Q/N281Q/ C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/ D165N, Q130E/N151D, N151D/K158E, E79Q/N151D, D55Q/N151D, N136D/N151D, N21D/N151D, E143Q/ N151D, N71Q/N85Q, N71Q/N195Q, N85Q/N195Q, N71Q/ N85Q/N195Q, N71D/N85D, N71D/N195D, and N85D/ N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/ N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E, xviii) IL-12p35(N136D), xix) (IL-12p35(E143Q)), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/ E153Q)), xxv) SEQ ID NO:228 (IL-12p35(N151D/ D165N)), xxvi) SEQ ID NO:229 (IL-12p35(Q130E/ N151D)), xxvii) SEQ ID NO:230 (IL-12p35(N151D/ K158E)), xxviii) SEQ ID NO:231 (IL-12p35(E79Q/ N151D)), xxix) SEQ ID NO:232 (IL-12p35(D55Q/ N151D)), xxx) SEQ ID NO:233 (IL-12p35(N136D/ N151D)), xxxi) SEQ ID NO:234 (IL-12p35(N21D/ N151D)), xxxii) SEQ ID NO:235 (IL-12p35(E143Q/ N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/ N85Q)), xxxix) SEQ ID NO: 283 (IL-12p35 (N71Q/ N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D)), xliv) SEQ ID NO:

288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, a Fc domain—a first domain linker—an IL-12p40 subunit domain—a second domain linker—an IL-12p35 subunit domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a homodimeric Fc fusion protein wherein said IL-12p40 subunit has amino acid substitutions selected from the group consisting of N103D/N13D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of:

i) SEQ ID NO:57 (IL-12p40(N103D)), ii) SEQ ID NO:58 (IL-12p40(N113D)), iii) SEQ ID NO:59 (IL-12p40 (N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40 (E45Q/Q56E/E59Q)), xvii) SEQ ID NO:73 (IL-12p40 (D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40 (E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40 (E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40 (D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a homodimeric Fc fusion protein comprising a first monomer and a second monomer each comprising, from N- to C-terminal, a Fc domain—a first domain linker—an IL-12p35 subunit domain—a second domain linker—an IL-12p40 subunit domain.

In some embodiments, the present invention provides a homodimeric Fc fusion protein, wherein said modifications promoting homodimerization of said Fc domain are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering.

In some embodiments, the present invention provides a homodimeric Fc fusion protein wherein said first domain linker and said second domain linker have the same amino acid sequence.

In some embodiments, the present invention provides a homodimeric Fc fusion protein wherein said Fc domain has an additional set of amino acid substitutions comprising Q295E/N384D/Q418E/N421D, according to EU numbering.

In some embodiments, the present invention provides a homodimeric Fc fusion protein, wherein said Fc domain has an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

In some embodiments, the present invention provides a homodimeric Fc fusion protein wherein said IL-12p40 subunit has a polypeptide sequence selected form the group consisting of SEQ ID NO:3 (human IL-12 subunit beta (IL-12p40) precursor sequence) and SEQ ID NO:4 (human IL-12 subunit beta (IL-12p40) mature form sequence), and said IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence).

In some embodiments, the present invention provides a homodimeric Fc fusion protein wherein each of said Fc domain further comprises amino acid substitutions M428L/N424S.

In some embodiments, the present invention provides a homodimeric Fc fusion protein wherein said IL-12p40 subunit is a variant IL-12p40 subunit and/or said IL-12p35 subunit is a variant IL-12p35 subunit.

In some embodiments, the present invention provides a homodimeric Fc fusion protein wherein said IL-12p40 subunit is a variant IL-12p40 subunit having altered affinity for IL-12 receptor subunit beta-1 (IL-12Rβ1), IL-12 receptor subunit beta-2 (IL-12Rβ2), and/or IL-12 receptor complex; and/or said IL-12p35 subunit is a variant IL-12p35 subunit having altered affinity for IL-12 receptor subunit beta-1 (IL-12Rβ1), IL-12 receptor subunit beta-2 (IL-12Rβ2), and/or IL-12 receptor complex.

In some embodiments, the present invention provides a homodimeric Fc fusion protein wherein said IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252S, Q256, K158, K260, E262, K264, D265, D270, N281, Q289, D290, R291, Y292, Y293, and E299.

In some embodiments, the present invention provides a homodimeric Fc fusion protein wherein said IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N10D, N103Q, N113D, N103Q, N13D, N13Q, Q144E, D161N, R159E, K163E, E187Q, N200D, N200Q, N218Q, Q229E, E235Q, C252S, Q256N, K258E, K260E, E262Q, K264E, N281D, N281Q, and E299Q.

In some embodiments, the present invention provides a homodimeric Fc fusion protein wherein said IL-12p40 subunit has amino acid substitutions selected from the group consisting of N103D/N13D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the present invention provides a homodimeric Fc fusion protein wherein said IL-12p40 subunit has a polypeptide sequence selected from the group consisting of:

i) SEQ ID NO:57 (IL-12p40(N103D)), ii) SEQ ID NO:58 (IL-12p40(N113D)), iii) SEQ ID NO:59 (IL-12p40 (N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40 (E45Q/Q56E/E59Q)), xvii) SEQ ID NO:73 (IL-12p40 (D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40 (E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40 (E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40 (D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/ E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/ E59K/K99E)), lii) SEQ ID NO: 343 (IL-12p40 (E59K/ K99E/K264E)), liii) SEQ ID NO: 336 (IL-12p40 (E59K/ K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N13D/N200D)), lxxiv) SEQ ID NO: 261 (IL-12p40 (N103D/N113D/N281D)), lxxv) SEQ ID NO: 262 (IL- 12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the present invention provides a homodimeric Fc fusion protein wherein said IL-12p35 subunit has one or more amino acid modifications as amino acid residues selected from the group consisting of: Q20, N21, Q35, E38, 544, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

In some embodiments, the present invention provides a homodimeric Fc fusion protein wherein said IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q.

In some embodiments, the present invention provides a homodimeric Fc fusion protein wherein said IL-12p35 subunit has amino acid substitutions selected from the group consisting of N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In some embodiments, the present invention provides a homodimeric Fc fusion protein wherein said IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the present invention provides a homodimeric Fc fusion protein wherein said first and second monomers are XENP31289.

In some embodiments, the present invention provides a homodimeric Fc fusion protein wherein said first and second monomers are XENP31291.

In some embodiments, the present invention provides a homodimeric Fc fusion protein composition comprising a homodimeric Fc fusion protein for use in treating cancer in a subject.

In some embodiments, the present invention provides a one or more nucleic acids encoding a homodimeric Fc fusion protein.

In some embodiments, the present invention provides a host cell comprising said one or more nucleic acids encoding a homodimeric Fc fusion protein.

In some embodiments, the present invention provides a method of making a homodimeric Fc fusion protein, said method comprising culturing a host cell under conditions whereby said homodimeric Fc fusion protein is produced.

In some embodiments, the present invention provides a method of purifying a homodimeric Fc fusion protein, said method comprising: a) providing a composition comprising the homodimeric Fc fusion protein; b) loading said composition onto an ion exchange column; and c) collecting a fraction containing said homodimeric Fc fusion protein.

In another aspect, the present invention provides a method of treating cancer in a patient in need thereof, the method comprising administering a therapeutically effective amount of a heterodimeric or homodimeric Fc fusion protein according to any of the previous claims to said patient.

In some embodiments, the present invention provides a method of treating cancer in a patient in need thereof, further comprising administering a therapeutically effective amount of a checkpoint blockade antibody.

In some further embodiments, the present invention provides a method of treating cancer in a patient in need thereof, wherein said checkpoint blockade antibody is selected from an anti-PD-1 antibody, an anti-PD-L1 antibody, an anti-TIM3 antibody, an anti-TIGIT antibody, an anti-LAG3 antibody, and an anti-CTLA-4 antibody.

In some further embodiments, the present invention provides a method of treating cancer in a patient in need thereof, wherein said anti-PD-1 antibody is nivolumab, pembrolizumab, or pidilizumab.

In some further embodiments, the present invention provides a method of treating cancer in a patient in need thereof, wherein said anti-PD-L1 antibody is atezolizumab, avelumab, or durbalumab.

In some further embodiments, the present invention provides a method of treating cancer in a patient in need thereof, wherein the patient exhibits an increase in lymphocytes following administration.

In some further embodiments, the present invention provides a method of treating cancer in a patient in need thereof, wherein the patient exhibits an increase in peripheral CD8+ T cells following administration.

In some embodiments, the present invention provides method of treating cancer in a patient in need thereof wherein the IL-12 Fc fusion protein is administered before the checkpoint inhibitor to increase checkpoint expression prior to treatment.

In some embodiments, the present invention provides a method of treating cancer in a patient in need thereof wherein the IL-12 Fc fusion protein is administered before the checkpoint inhibitor to increase checkpoint expression prior to treatment.

In another aspect, the present invention provides a method of inducing T cell expansion in a patient in need thereof comprising administering a therapeutically effective amount of a heterodimeric or homodimeric Fc fusion protein according any of the previous claims to said patient.

In some further embodiments, the present invention provides a method of inducing T cell expansion in a patient in need thereof, further comprising administering a therapeutically effective amount of a checkpoint blockade antibody.

In some further embodiments, the present invention provides a method of inducing T cell expansion in a patient in need thereof, wherein said checkpoint blockade antibody is selected from an anti-PD-1 antibody, an anti-PD-L1 antibody, an anti-TIM3 antibody, an anti-TIGIT antibody, an anti-LAG3 antibody, and an anti-CTLA-4 antibody.

In some further embodiments, the present invention provides a method of inducing T cell expansion in a patient in need thereof, wherein said anti-PD-1 antibody is nivolumab, pembrolizumab, or pidilizumab.

In some other further embodiments, the present invention provides a method of inducing T cell expansion in a patient in need thereof, wherein said anti-PD-L1 antibody is atezolizumab, avelumab, or durbalumab.

In some further embodiments, the present invention provides a method of inducing T cell expansion in a patient in need thereof, wherein the T cell expansion is at least a 2-fold increase in T cells.

In some embodiments, the present invention provides a method of inducing T cell expansion in a patient in need thereof wherein the IL-12 Fc fusion protein is administered before the checkpoint inhibitor to increase checkpoint expression prior to treatment.

In some embodiments, the present invention provides a method of inducing T cell expansion in a patient in need thereof wherein the IL-12 Fc fusion protein is administered before the checkpoint inhibitor to increase checkpoint expression prior to treatment.

In one aspect the present invention provides an IL-12p40 subunit. In another aspect the present invention provides an IL-12p35 subunit. In a further aspect the present invention provides a heterodimeric complex comprising a) an IL-12p40 subunit and b) a IL-12p35 subunit.

BRIEF DESCRIPTION OF THE DRAWINGS

FIGS. 1A and 1B depicts the sequences for IL-12 and its receptors.

FIG. 2A-2E depicts useful pairs of Fc heterodimerization variant sets (including skew and pI variants). Variants without a corresponding "monomer 2" are pI variants which can be used alone on either monomer.

FIG. 3 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 4 depicts useful ablation variants that ablate FcγR binding (sometimes referred to as "knock outs" or "KO" variants). Generally, ablation variants are found on both monomers, although in some cases they may be on only one monomer.

FIG. 5 shows particularly useful embodiments of "non-cytokine" components of the invention.

FIG. 6 depicts a number of exemplary domain linkers. In some embodiments, these linkers find use linking the IL-12p35 subunit, the IL-12p40 subunit, or the single-chain IL-12 complex to the N-terminus of the Fc region. In some embodiments, these linkers find use fusing IL-12p35 subunit to the IL-12p40 subunit in the single-chain IL-12 complex. It is important to note that the scIL-12 complex can comprise either IL-12p35 N-terminally linked to IL-12p40 or IL-12p40 N-terminally linked to IL-12p35. Also, in some cases as described herein, the hinge portion of an Fc domain serves as a domain linker, which can be combined with any of these linkers as well.

FIG. 7A-7E shows the sequences of several useful IL-12-Fc fusion backbones based on human IgG1, without the cytokine sequences (e.g. the IL-12p35 subunit, the IL-12p40 subunit, or the scIL-12 complex). Backbone 1 is based on human IgG1 (356E/358M allotype), and includes C220S on both chains, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes C220S on both chains, the S364K: L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chains, the S364K: L368E/K370S skew variants, the Q295E/N384D/Q418E/N421D pI variants on the chain with L368E/K370S skew variants and the E233P/L234V/L235A/ G236del/S267K ablation variants on both chains. Backbone 4 is based on human IgG1 (356E/358M allotype), and includes C220S on both chains, the D401K:K360E/Q362E/ T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chains, the S364K/E357Q:L368D/K370S skew variants, the Q295E/N384D/Q418E/N421D pI variants on the chain with L368D/K370S skew variants and the E233P/L234V/L235A/ G236del/S267K ablation variants on both chains. Backbone 6 is based on human IgG1 (356E/358M allotype), and includes C220S on both chains, the S364K/E357Q:L368D/ K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/ N384D/Q418E/N421D pI variants on the chain with L368D/ K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L1N434S Xtend mutations. Backbone 12 is based on human IgG1 (356E/358M allotype), and includes C220S on both identical chain, the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/ P229R/N276K pI variants on the chain with S364K/E357Q skew variants and the E233P/L234V/L235A/G236del/ S267K ablation variants on both chains.

Figure 8A:
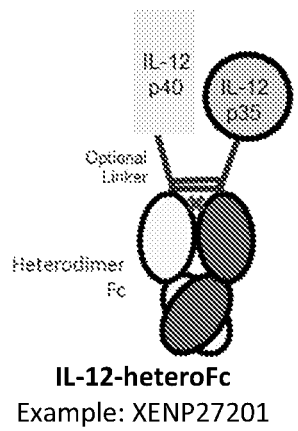

As will be appreciated by those in the art and outlined below, these sequences can be used with any IL-12-Fc fusion formats outlined herein, including but not limited to IL-12-heteroFc, heteroFc-IL-12, and scIL-12-Fc formats as schematically depicted in FIG. 8. It should be noted that for heteroFc-IL-12 fusions, the backbones may further comprise deletion of K447. Additionally, any IL-12p35 and/or IL-12p40 variants can be incorporated into these FIG. 7 backbones in any combination.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIGS. 8A-8F depict illustrative formats for the IL-12-Fc fusion proteins of the present invention. The N-terminal IL-12 heterodimeric Fc fusion or "IL-12-heteroFc" (FIG. 8A) format comprises the IL-12p40 subunit recombinantly fused to the N-terminus of one side of a heterodimeric Fc and the IL-12p35 subunit recombinantly fused to N-terminus of the other side of the heterodimeric Fc. The IL-12p35 and IL-12p40 subunits may be linked to their respective Fc chains by a domain linker. The C-terminal IL-12 heterodimeric Fc fusion or "heteroFc-IL-12" (FIG. 8B) format comprises the IL-12p40 subunit recombinantly fused to the C-terminus of one side of a heterodimeric Fc and the IL-12p35 subunit recombinantly fused to the C-terminus of the other side of the heterodimeric Fc. The IL-12p35 and IL-12p40 subunits may be linked to their respective Fc chains by a domain linker. The N-terminal single-chain IL-12-Fc fusion or "scIL-12-Fc" (FIGS. 8C-D) format comprises a single-chain IL-12 complex (or "scIL-12 complex") recombinantly fused to the N-terminus of one side of a heterodimeric Fc (optionally via a domain linker), with the other side of the molecule being a "Fc-only" or "empty-Fc" heterodimeric Fc. The C-terminal single-chain IL-12-Fc fusion or "Fc-scIL-12" (FIGS. 8E-F) format comprises a scIL-12 complex recombinantly fused to the C-terminus of one side of a heterodimeric Fc (optionally via a domain linker), with the other side of the molecule being a "Fc-only" or "empty-Fc" heterodimeric Fc. The scIL-12 complex can comprise either IL-12p35 N-terminally linked to IL-12p40 or IL-12p40 N-terminally linked to IL-12p35, optionally but generally with a domain linker. The order of the two subunits in the scIL-12 complex may be designated as follows: "scIL-12(p40/p35)", wherein the IL-12p40 subunit is N-terminally linked to the IL-12p35 subunit, or "scIL-12(p35/ p40)", wherein the IL-12p35 is N-terminally linked to the IL-12p40 subunit.

FIG. 9 depicts the sequences of XENP27201, an illustrative IL-12-Fc fusion protein of the "IL-12-heteroFc" format, that contains the wild-type IL-12p40 and wild-type IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 10 depicts the sequences of XENP27202, an illustrative IL-12-Fc fusion protein of the "heteroFc-IL-12" format, that contains the wild-type IL-12p40 and wild-type IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 11 depicts the sequences of XENP27203 and XENP27204, illustrative IL-12-Fc fusion proteins of the "scIL-12-Fc" format, that contains the wild-type IL-12p40 and wild-type IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

Figure 12A:
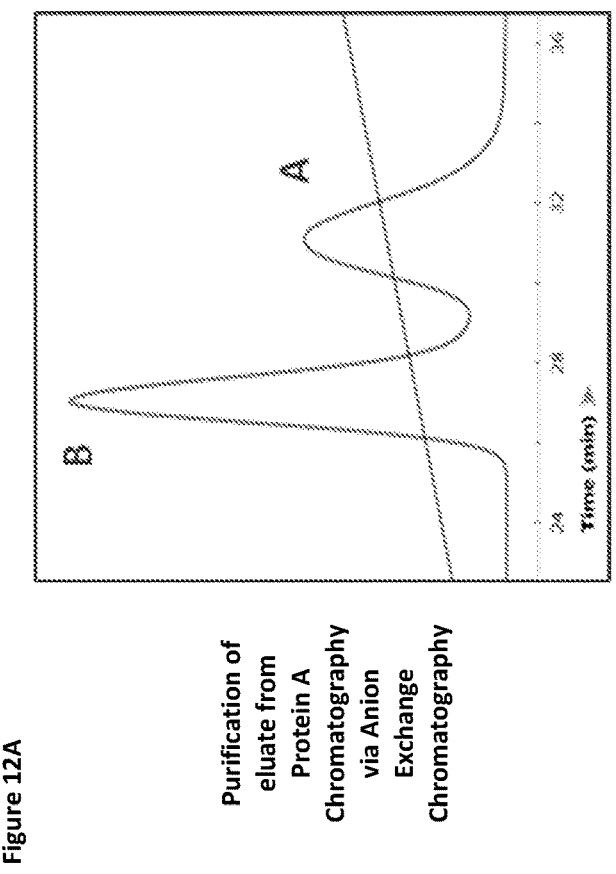
Figure 12B:
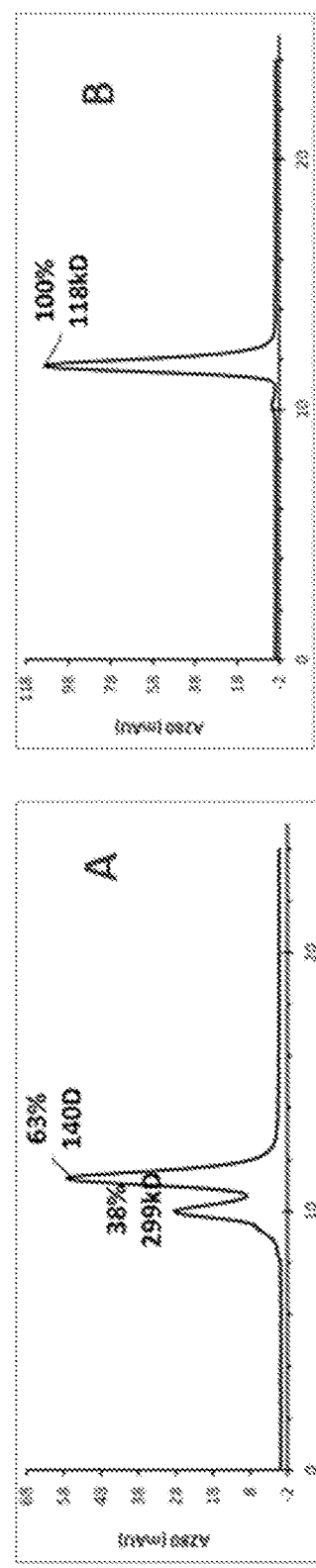
Figure 12C:
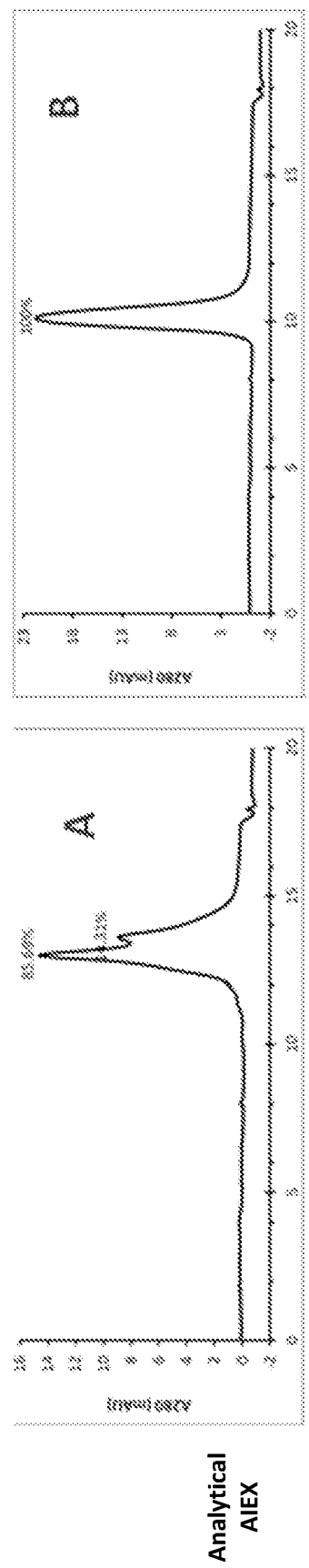

FIG. 12A-12C depict A) chromatogram illustrating purification part 2 of XENP27201 (anion exchange chromatography following protein A chromatography), and the purity and homogeneity of peak B isolated from anion exchange separation as depicted in FIG. 12A in comparison to peak A as determined by B) analytical size-exclusion chromatography with multi-angle light scattering (aSEC-MALS) and C) analytical anion exchange chromatography (analytical AIEX). FIG. 12B also depicts the molecular weight of protein species in peaks as determined by multi-angle light scattering.

Figure 13C:
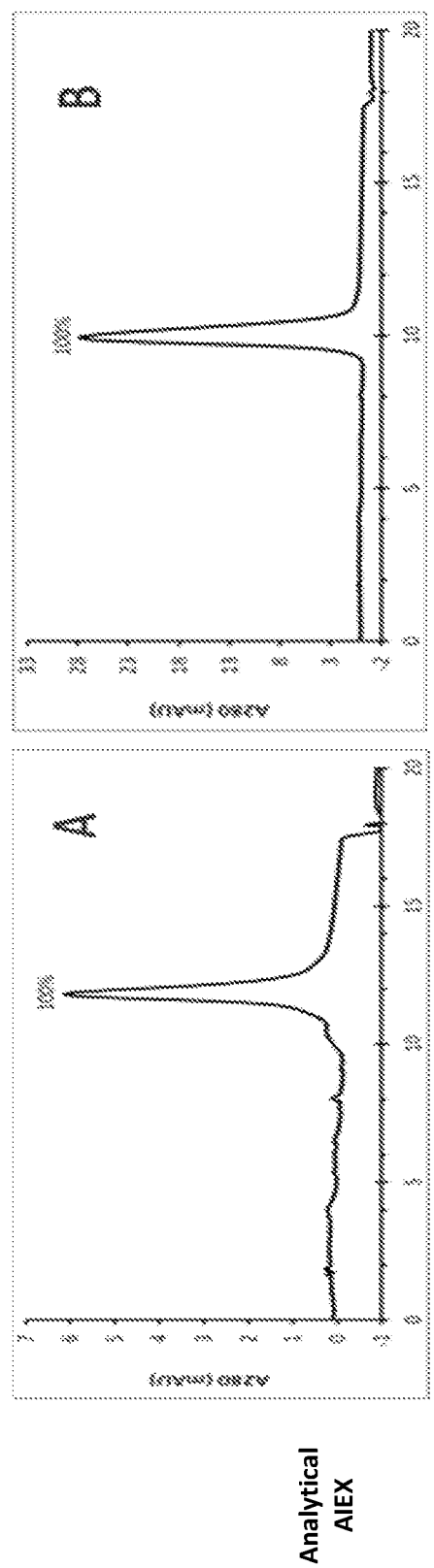
Figure 16A:
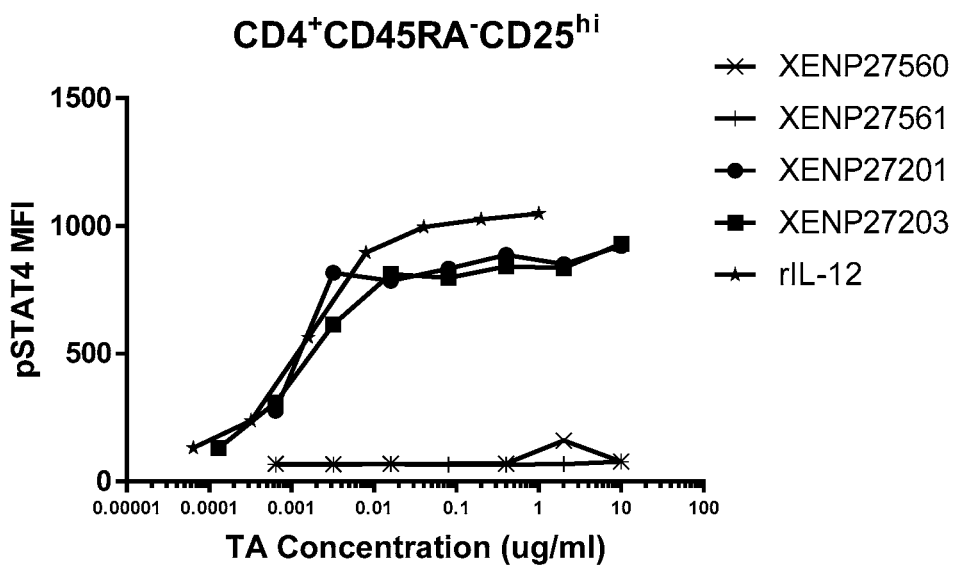
Figure 16B:
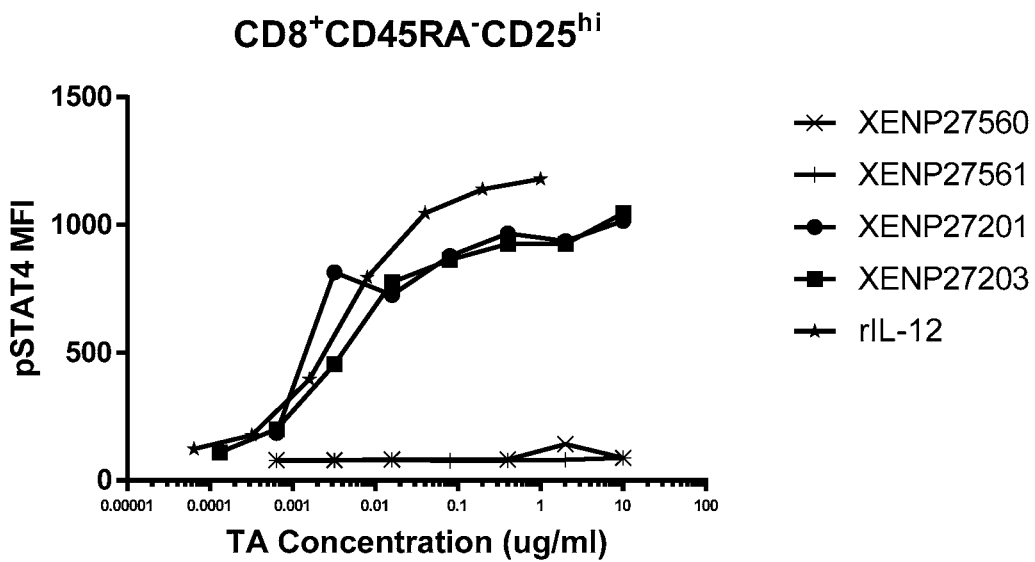
Figure 16C:
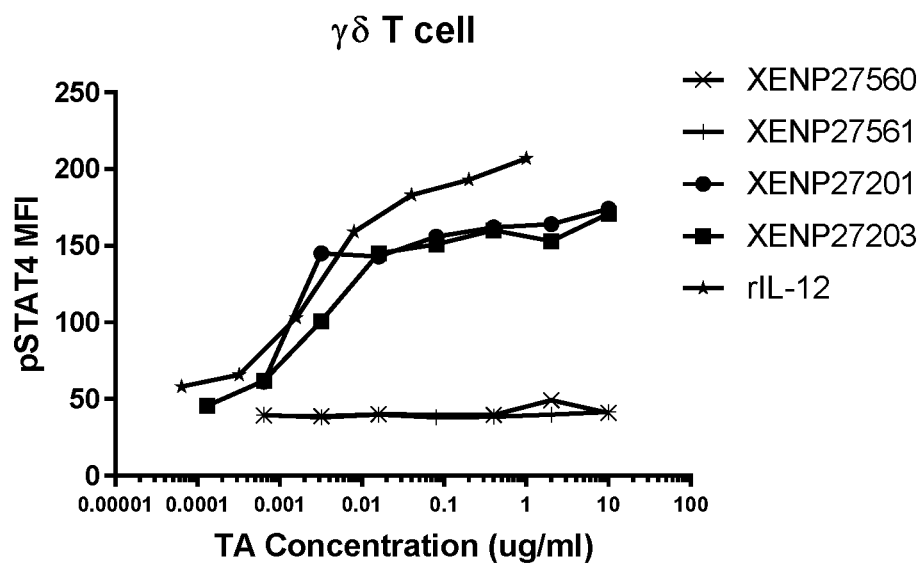
Figure 16D:
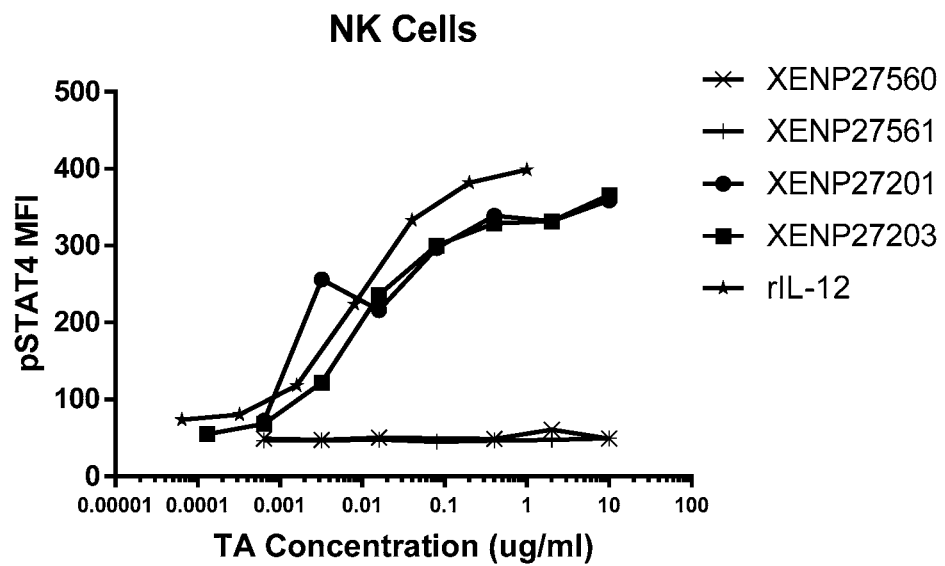

FIG. 13A-13C depicts A) chromatogram illustrating purification part 2 of XENP27203 (anion exchange chromatography following protein A chromatography), and the purity and homogeneity of peak B isolated from anion exchange separation as depicted in FIG. 13A in comparison to peak A as determined by B) analytical size-exclusion chromatography with multi-angle light scattering (SEC-MALS) and C) analytical anion exchange chromatography. FIG. 13B also depicts the molecular weight of protein species in peaks as determined by multi-angle light scattering.

FIG. 14A-14B depicts cartoon schematics for A) bivalent IL-12p40-Fc fusion and B) bivalent IL-12p35-Fc fusion. Each fusion comprises either IL-12p40 or IL-12p35 subunits recombinant fused to the N-terminus of a homodimeric Fc. The subunits may have a domain linker between their respective C-terminus and the N-terminus of the Fc region.

FIG. 15 depicts the sequences of XENP27560, a bivalent IL-12p40-Fc fusion, and XENP27561, a bivalent IL-12p35-Fc fusion (cartoon schematics depicted in FIG. 14), that contains the wild-type IL-12p40 and wild-type IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 16A-16D depicts STAT4 phosphorylation on A) CD4$^+$CD45RA$^-$CD25$^{hi}$ T cells, B) CD8$^+$CD45RA$^-$CD25$^{hi}$ T cells, C) γδ T cells, and D) NK cells following incubation of activated PBMCs with the indicated test articles.

FIG. 17 depicts residues on IL-12p40 (based on IL-12p40 mature form sequence) predicted to contribute to the binding of IL-12p40 with IL-12 receptors.

FIG. 18 depicts aspartic acid, glutamic acid, asparagine, and glutamine residues on IL-12p40 (based on IL-12p40 mature form sequence) identified using the QuaSAR package in MOE to have an ASA score (water accessible surface area calculated using a radius of 1.4 Å for the water molecule and a polyhedral representation for each atom) of at least 19.

FIG. 19 depicts residues on IL-12p40 (based on IL-12p40 mature form sequence) predicted to be in contact with IL-23 receptors (based on crystal structure deposited in the PDB with accession number 5MZV) as well as the predicted contact type(s). "D" indicates contact predicted based on proximity. "H" indicates contact predicted based on potential hydrogen bond. "I" indicates contact predicted based on potential salt bridge. "A" indicates contact predicted based potential arene binding.

FIG. 20A-20I depicts sequences for illustrative IL-12p40 variants designed with the view to reduce the affinity of the IL-12 heterodimeric complex for the IL-12 receptors and/or remove putative glycosylation sites. Modified amino acids are underlined and in bold.

FIG. 21A-21J depicts the amino acid sequences for illustrative IL-12p40 variants with Fc fusion partners. Domain linkers are double-underlined, and IL-12p40 variants are italicized.

FIG. 22 depicts aspartic acid, glutamic acid, asparagine, and glutamine residues on IL-12p35 (based on IL-12p35 mature form sequence) identified using the QuaSAR package in MOE to have an ASA score (water accessible surface area calculated using a radius of 1.4 Å for the water molecule and a polyhedral representation for each atom) of at least 103.

FIG. 23A-23C depicts sequences for illustrative IL-12p35 variants designed with the view to reduce the affinity of the IL-12 heterodimeric complex for the IL-12 receptors and/or remove putative glycosylation sites. Modified amino acids are underlined and in bold.

FIG. 24A-24D depicts the amino acid sequences for illustrative IL-12p35 variants with Fc fusion partners. Domain linkers are double-underlined, and IL-12p35 variants are italicized.

FIG. 25A-25Q depicts sequences for illustrative variant IL-12-Fc fusions designed with the view to reduce the affinity of the IL-12-Fc fusions for IL-12 receptors or to remove putative glycosylation sites. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

Figure 26A:
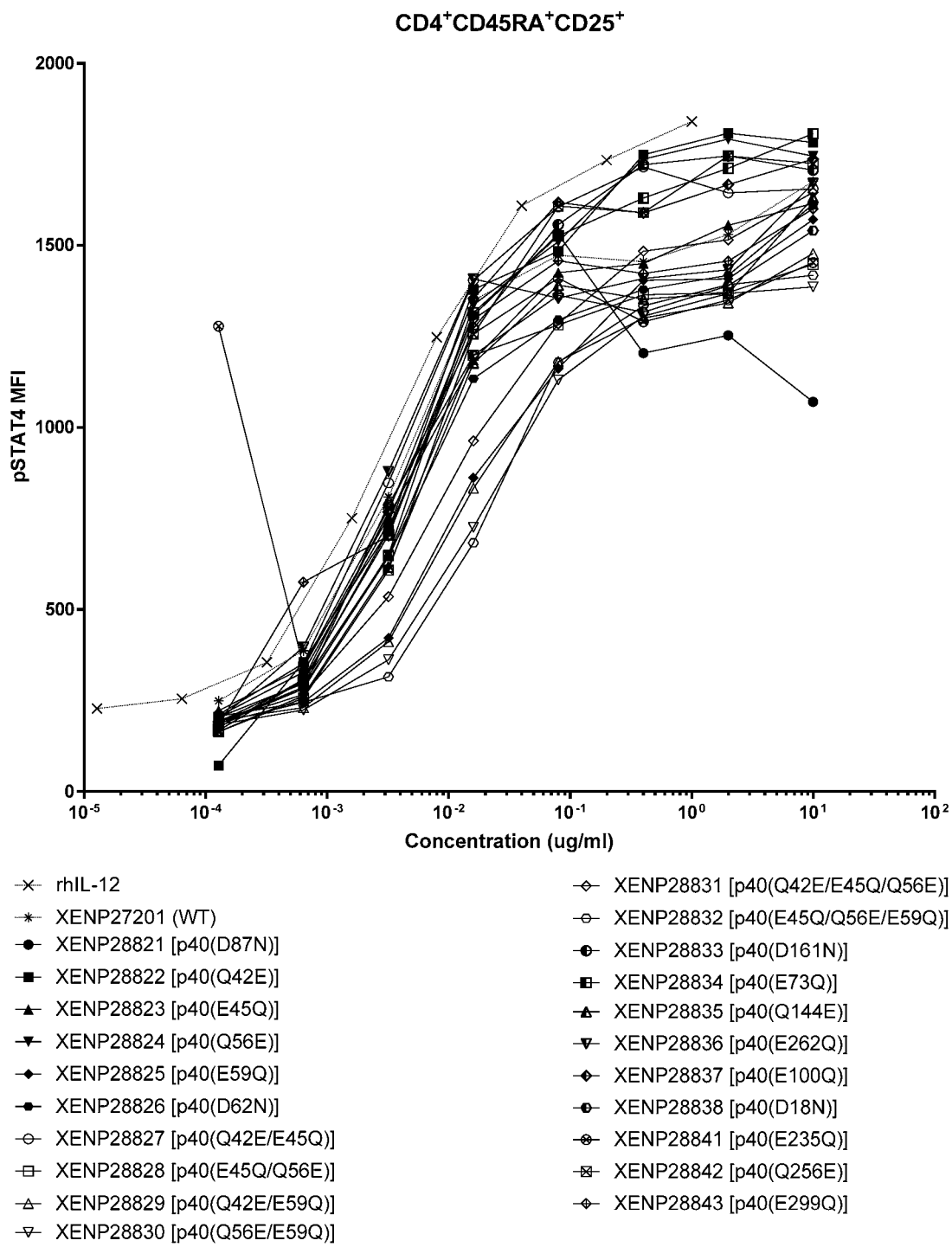
Figure 26B:
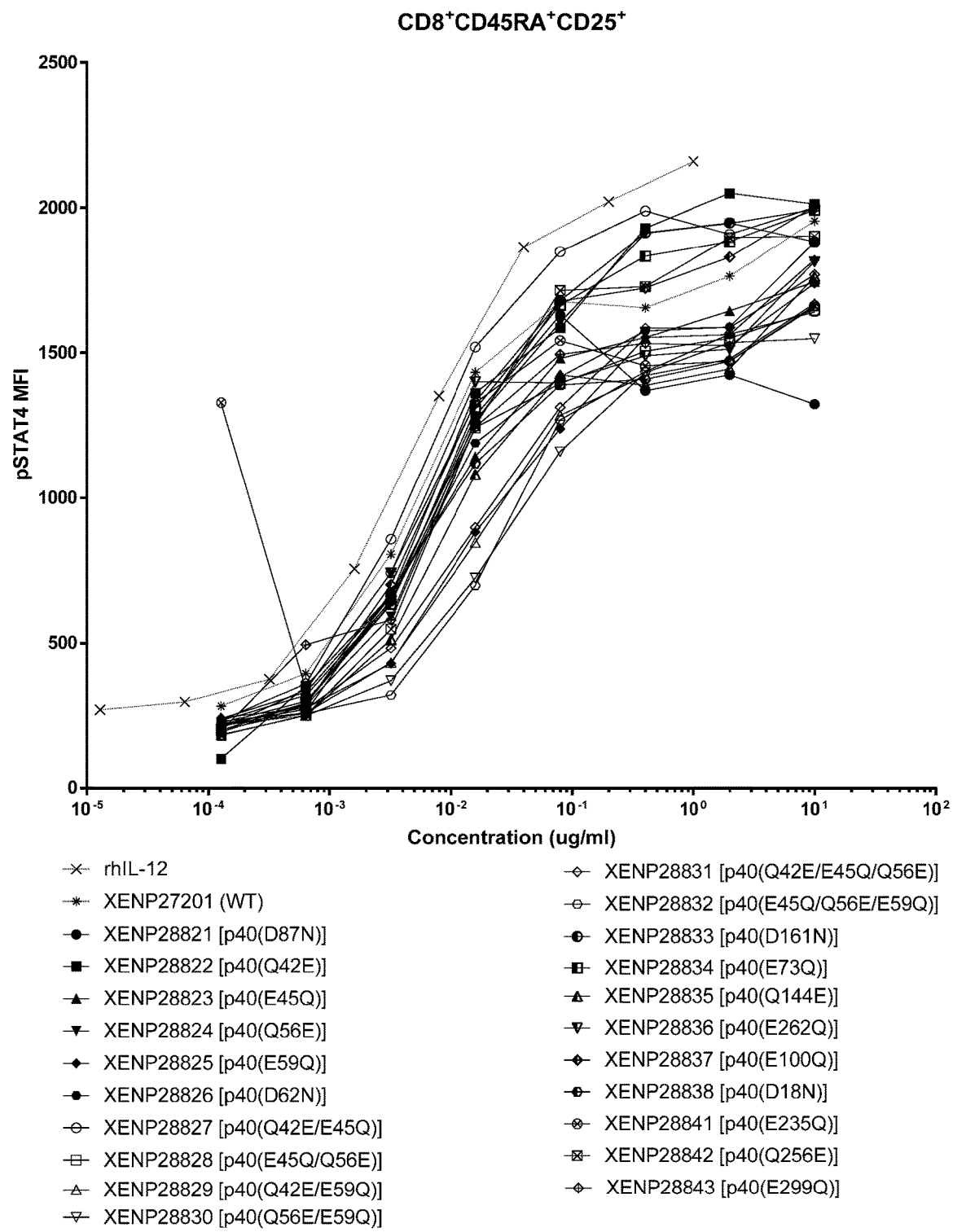
Figure 27A:
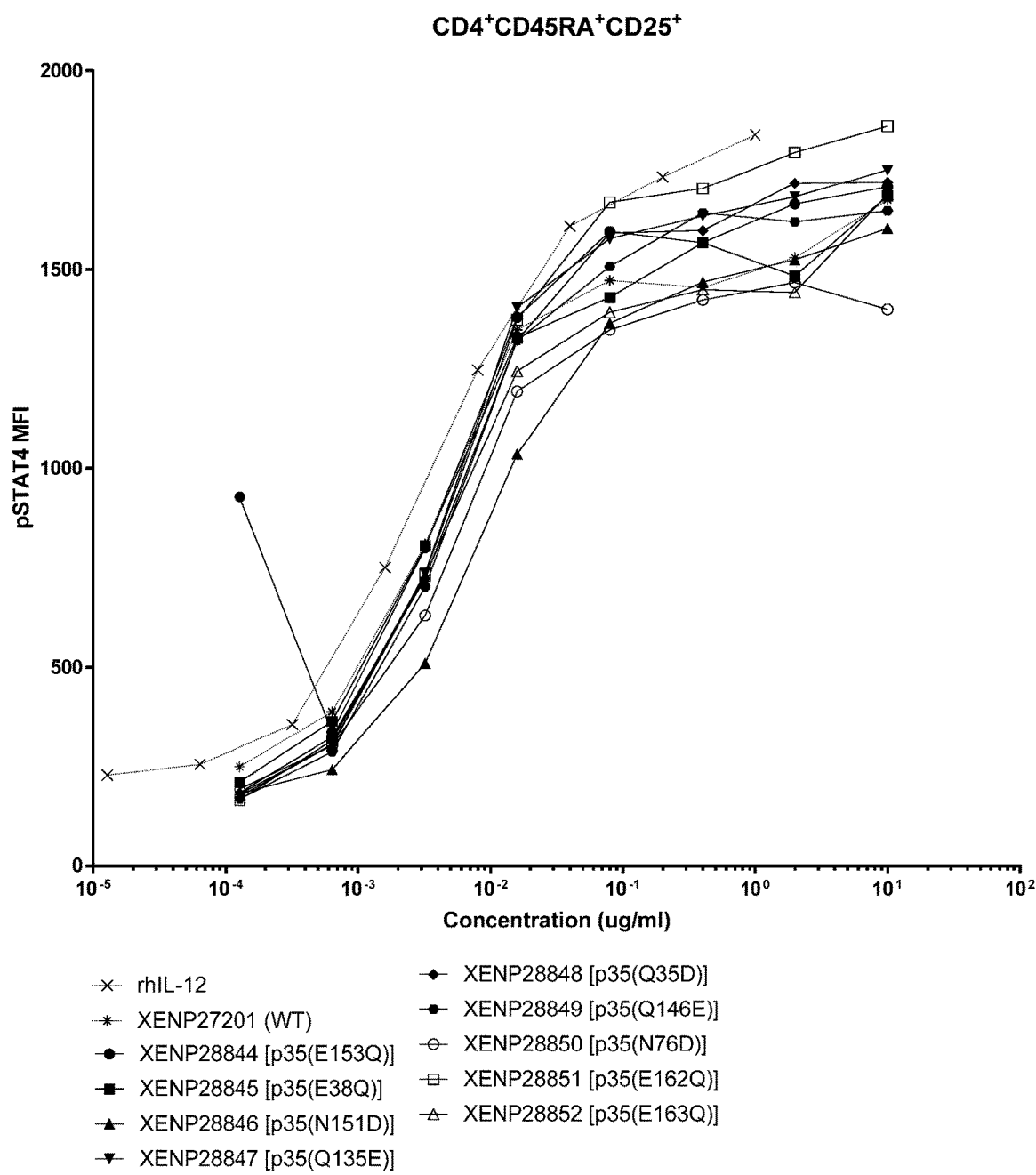
Figure 27B:
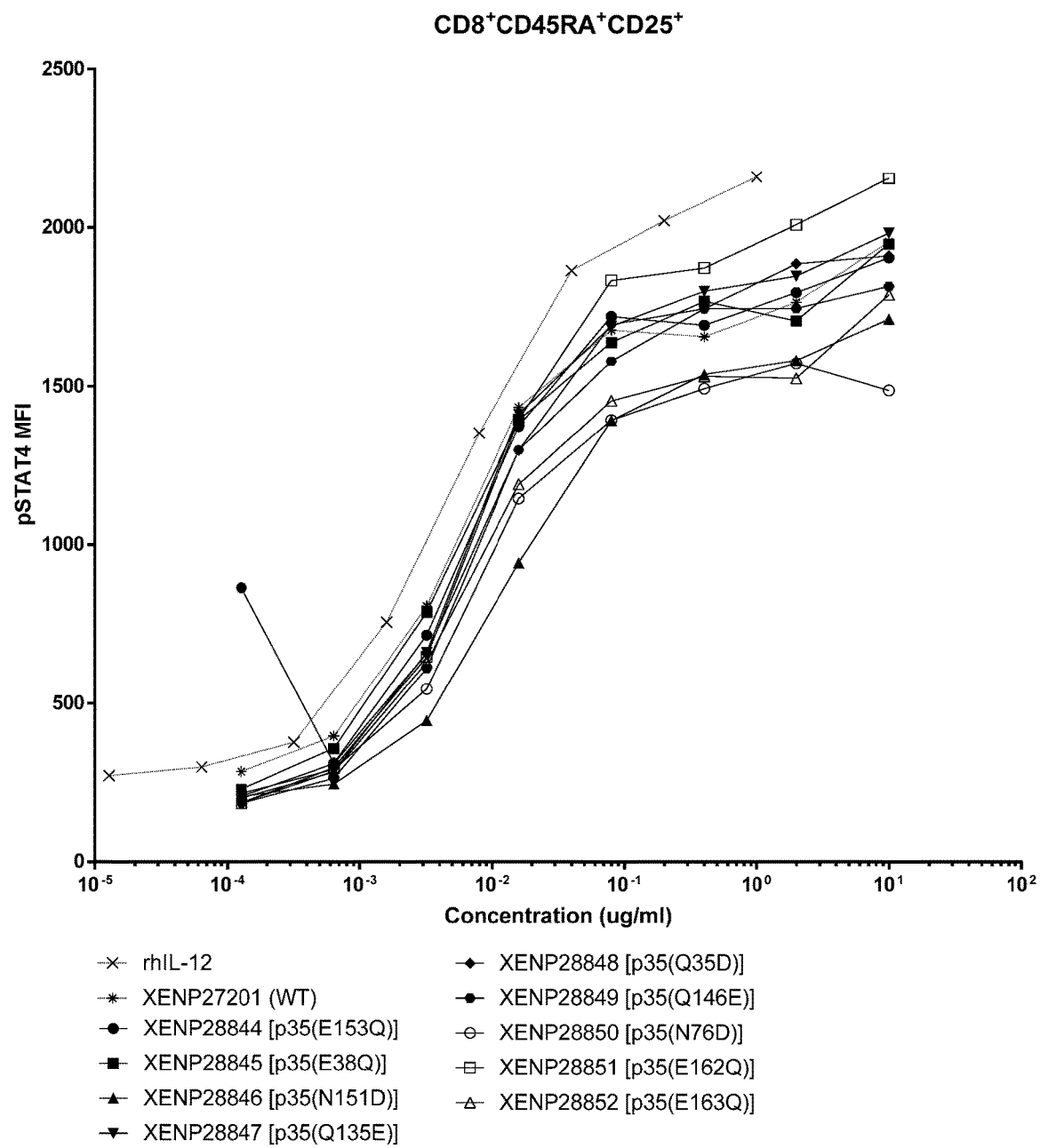

FIG. 26A-26B depicts STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p40 variants engineered with an aim to reduce affinity and potency FIG. 27A-27B depicts STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p35 variants engineered with an aim to reduce affinity and potency FIG. 28 depicts the EC50 (for STAT4 phosphorylation) as IL-12-Fc fusions comprising IL-12p40 or IL-12p35 variants and the fold decrease in EC50 relative to WT IL-12-Fc XENP27201. 27201-1 and 27201-2 represent two separately produced batches of XENP27201.

FIG. 29A-29B depicts sequences for illustrative IL-12p40 variants designed with the view to reduce the affinity of the IL-12 heterodimeric complex for the IL-12 receptors. Modified amino acids are underlined and in bold.

FIG. 30A-30D depicts the amino acid sequences for illustrative IL-12p40 variants with Fc fusion partner. Domain linkers are double-underlined, and IL-12p40 variants are italicized.

FIG. 31A-31B depicts sequences for illustrative IL-12p35 variants designed with the view to reduce the affinity of the IL-12 heterodimeric complex for the IL-12 receptors. Modified amino acids are underlined and in bold.

FIG. 32A-32C depicts the amino acid sequences for illustrative IL-12p35 variants with Fc fusion partners. Domain linkers are double-underlined, and IL-12p35 variants are italicized.

FIG. 33A-33P depicts sequences for illustrative variant IL-12-Fc fusions designed with the view to reduce the affinity of the IL-12-Fc fusions for IL-12 receptors. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

Figure 34A:
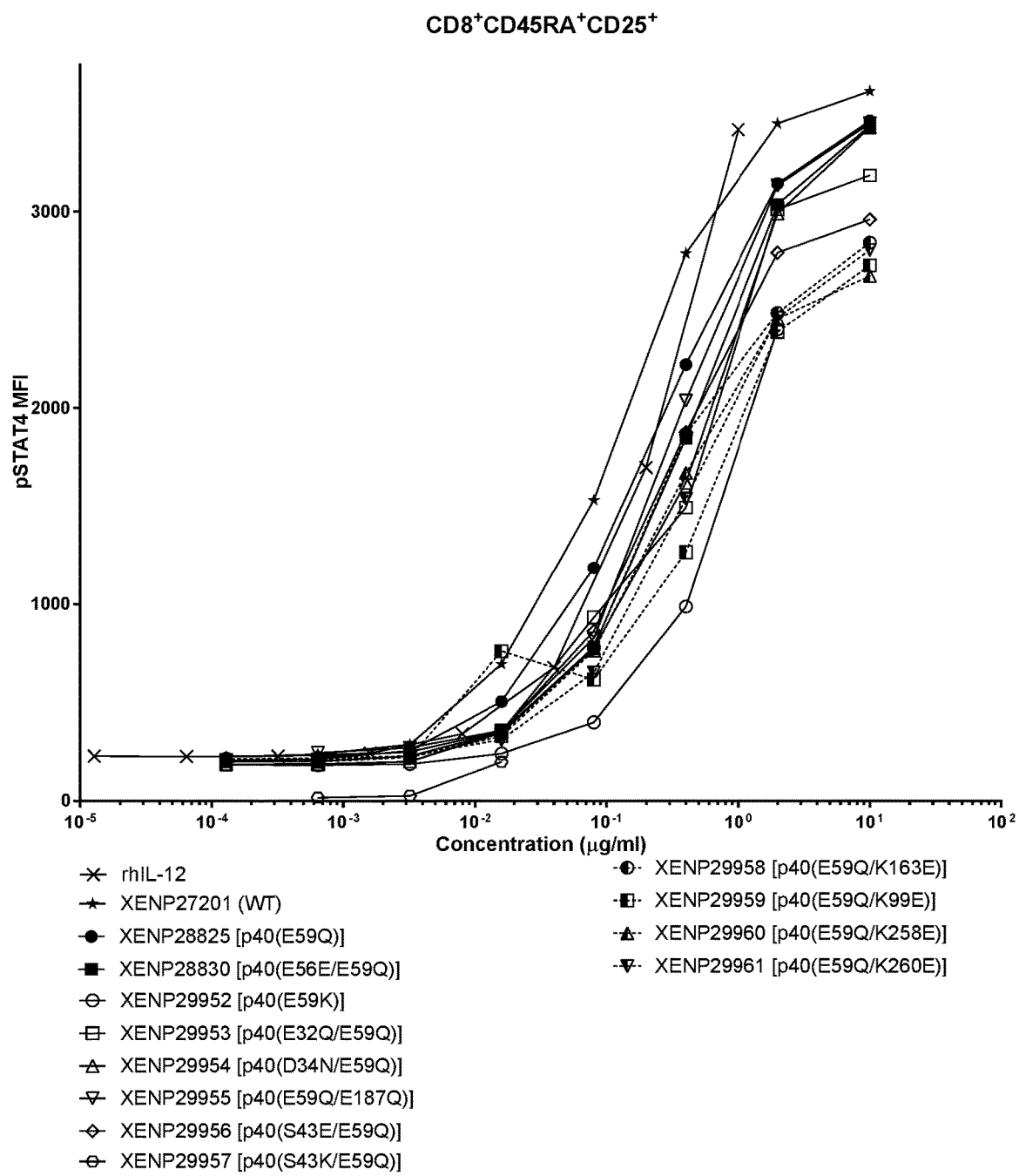
Figure 34B:
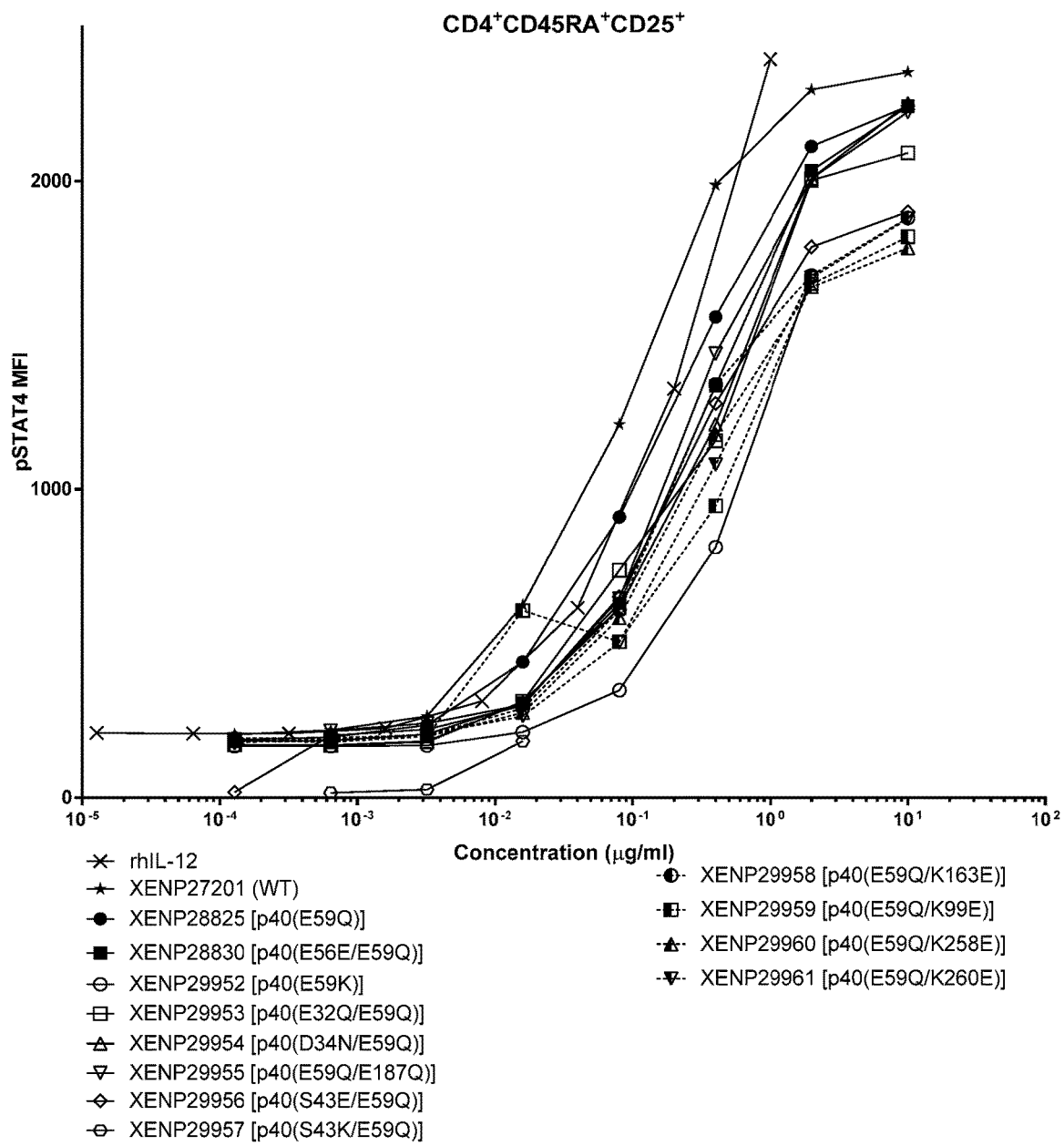

FIGS. 34A and 34B depicts STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p40 variants engineered with an aim to reduce affinity and potency.

Figure 35A:
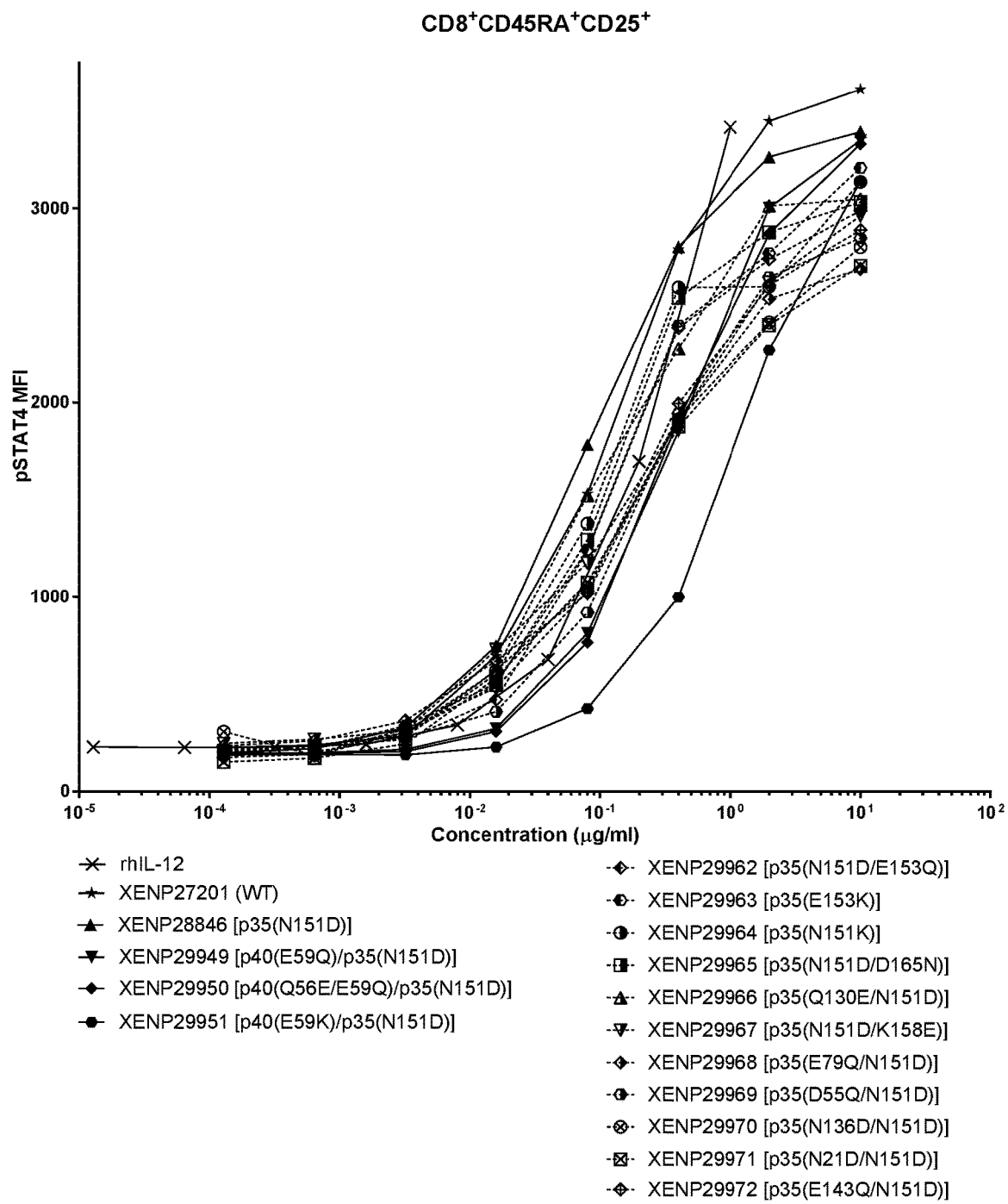
Figure 35B:
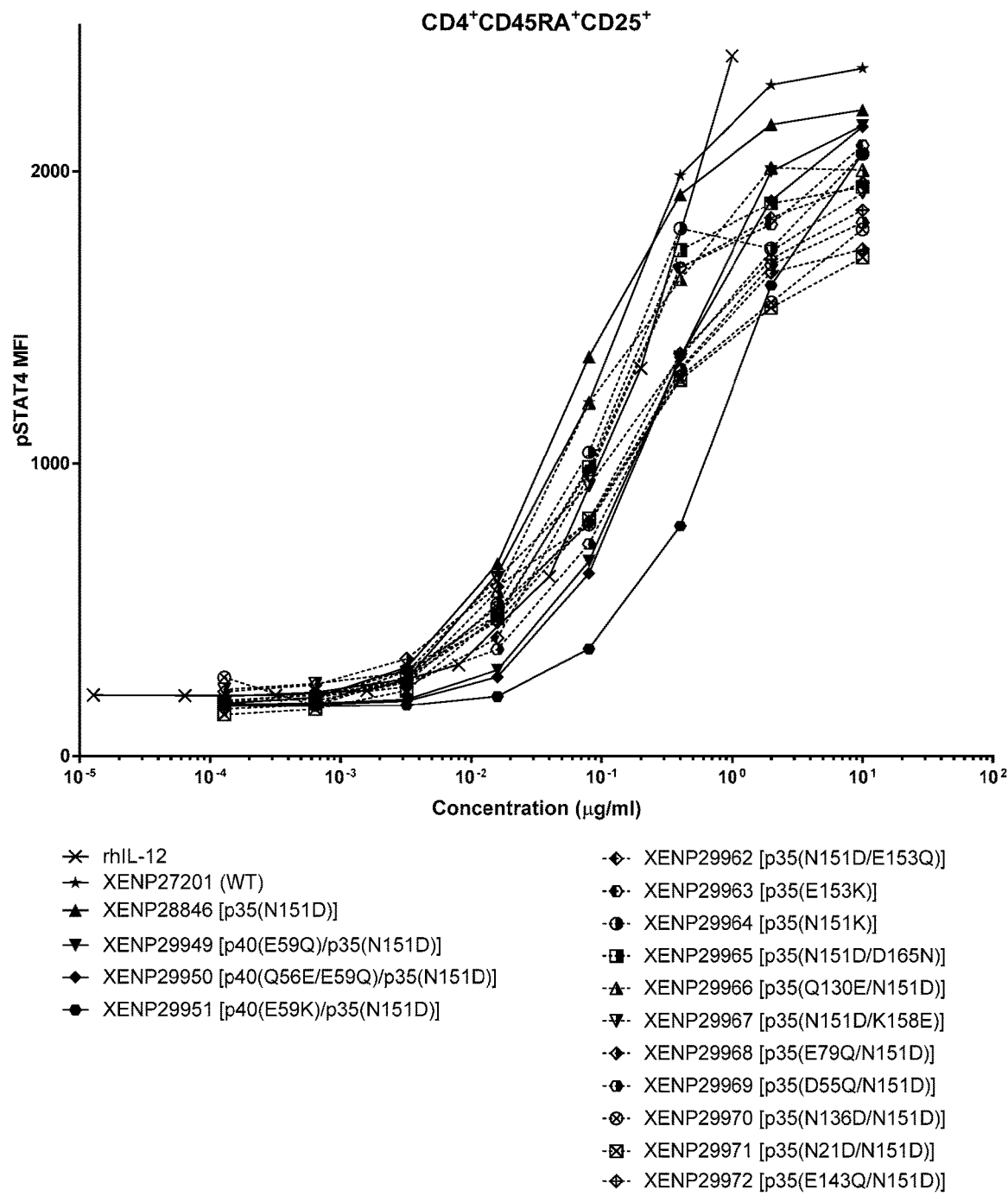

FIGS. 35A and 35B depicts STAT4 phosphorylation on A) CD4+CD45RA+CD25+ T cells and B) CD8+CD45RA+CD25+ T cells following incubation of activated PBMCs with IL-12-Fc fusions comprising IL-12p40 and/or IL-12p35 variants engineered with an aim to reduce affinity and potency.

FIG. 36 depicts the EC50 (for STAT4 phosphorylation) of IL-12-Fc fusions comprising IL-12p40 and/or IL-12p35 variants and the fold decrease in EC50 relative to WT IL-12-Fc XENP27201. The data show that potency was reduced by up to 12-fold by an IL-12-Fc fusion comprising only a E59K substitution in the IL-12p40 subunit.

FIG. 37A-37B depicts sequences for illustrative IL-12p40 variants designed with the view to reduce the affinity of the IL-12 heterodimeric complex for the IL-12 receptors. Modified amino acids are underlined and in bold.

FIG. 38 depicts sequences for illustrative IL-12p35 variants designed with the view to reduce the affinity of the IL-12 heterodimeric complex for the IL-12 receptors. Modified amino acids are underlined and in bold.

FIG. 39A-39I depicts sequences for illustrative variant IL-12-Fc fusions designed with the view to reduce the affinity of the IL-12-Fc fusions for IL-12 receptors. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

Figure 40A:
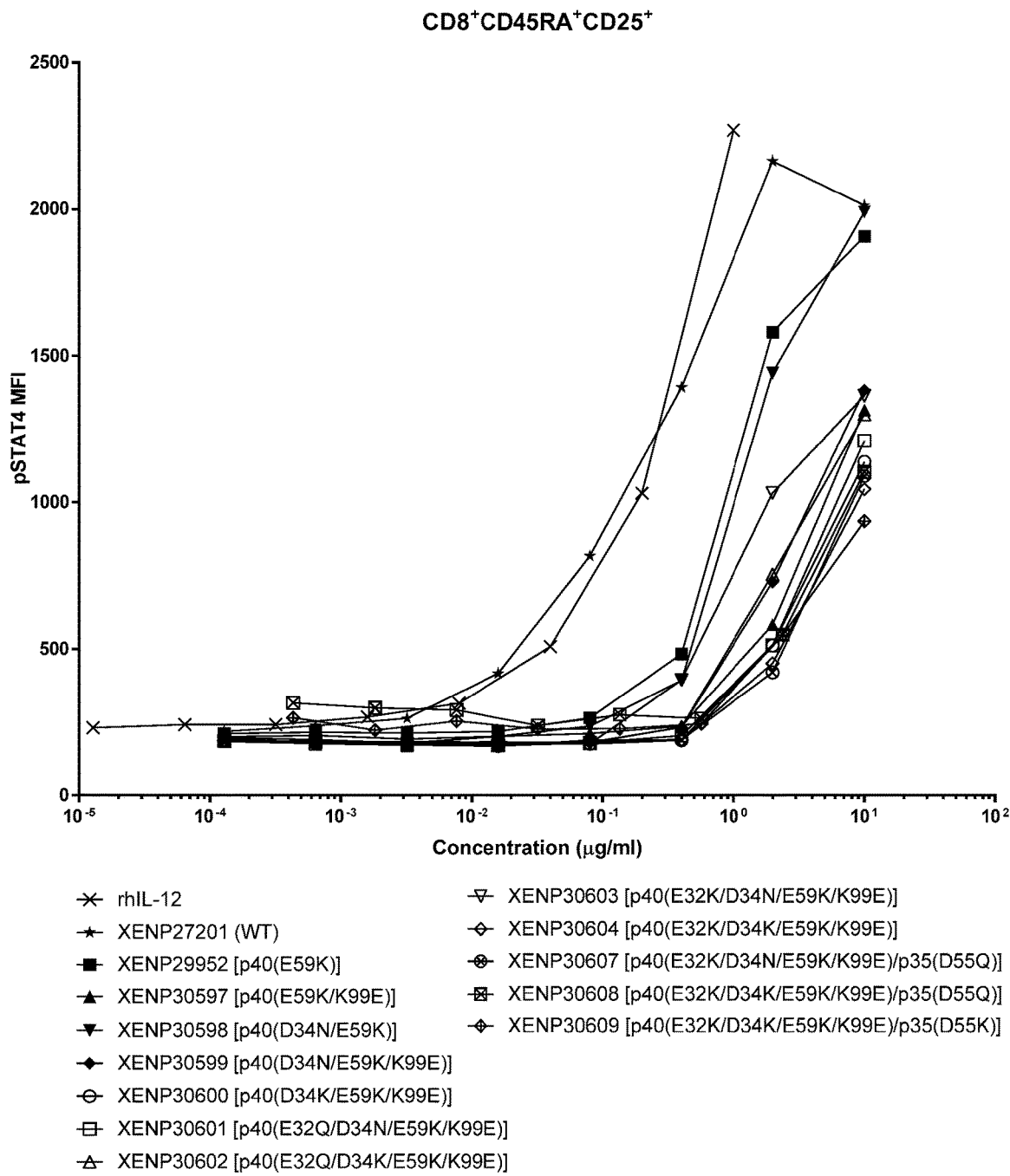
Figure 40B:
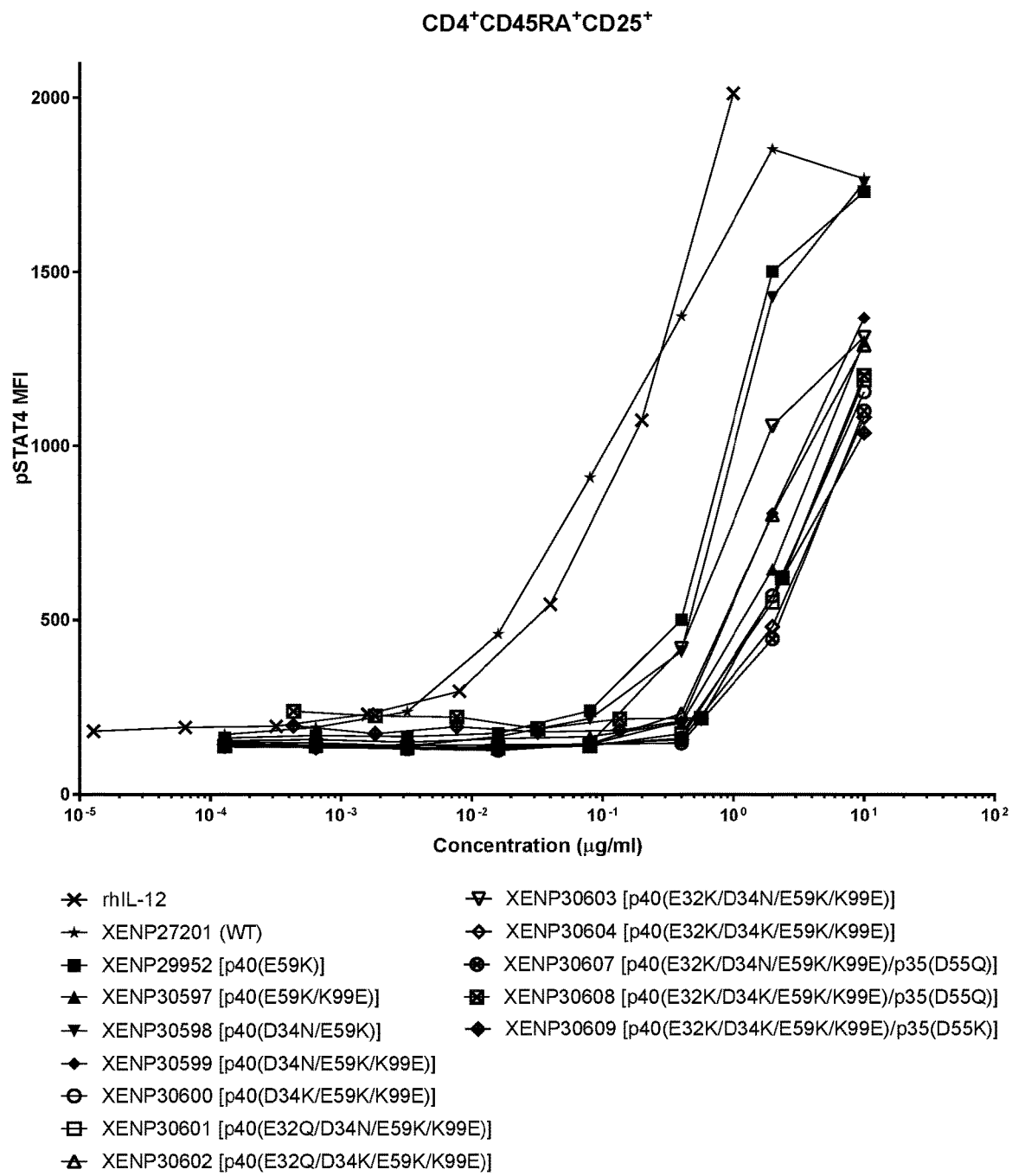
Figure 46A:
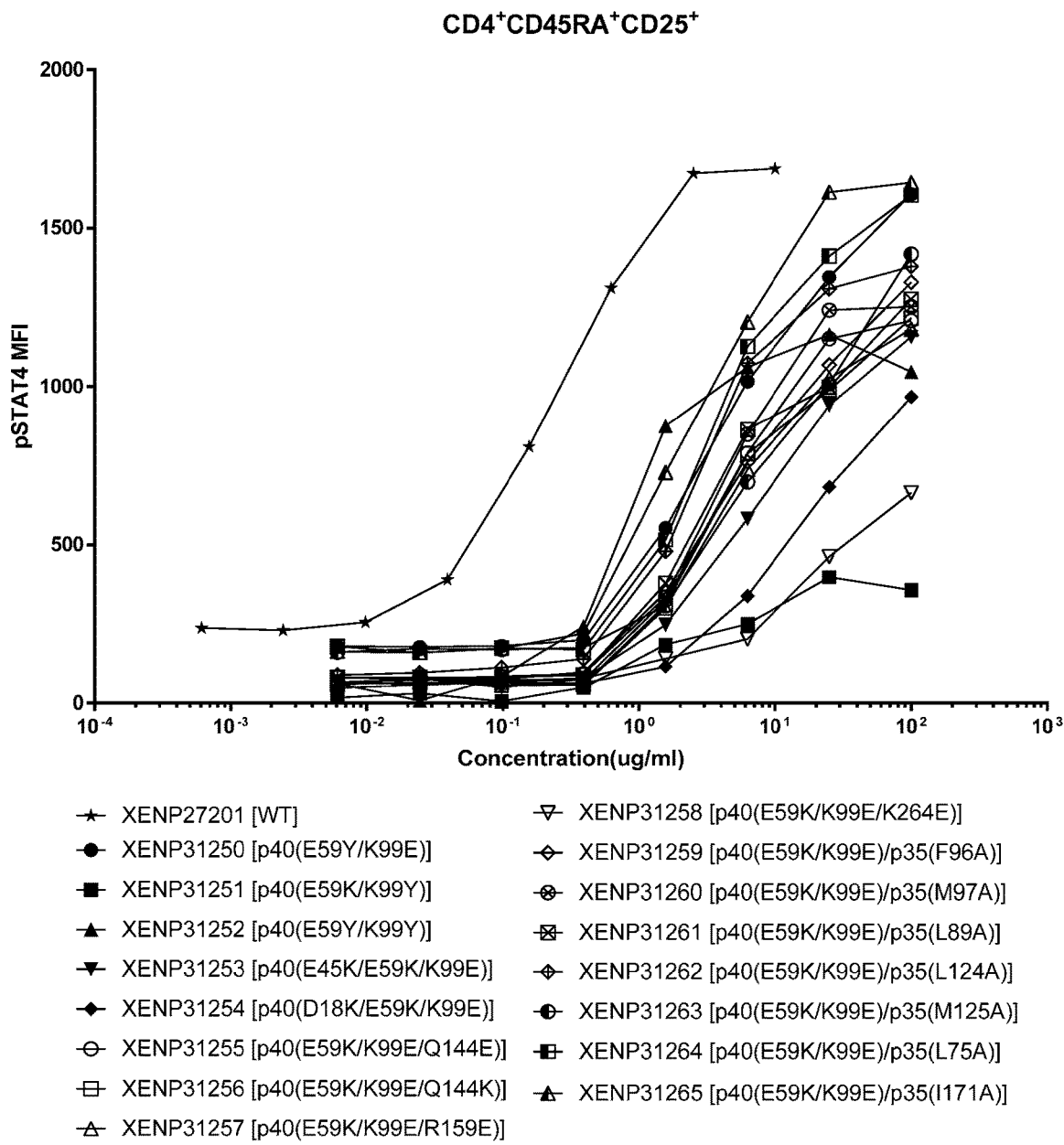
Figure 46B:
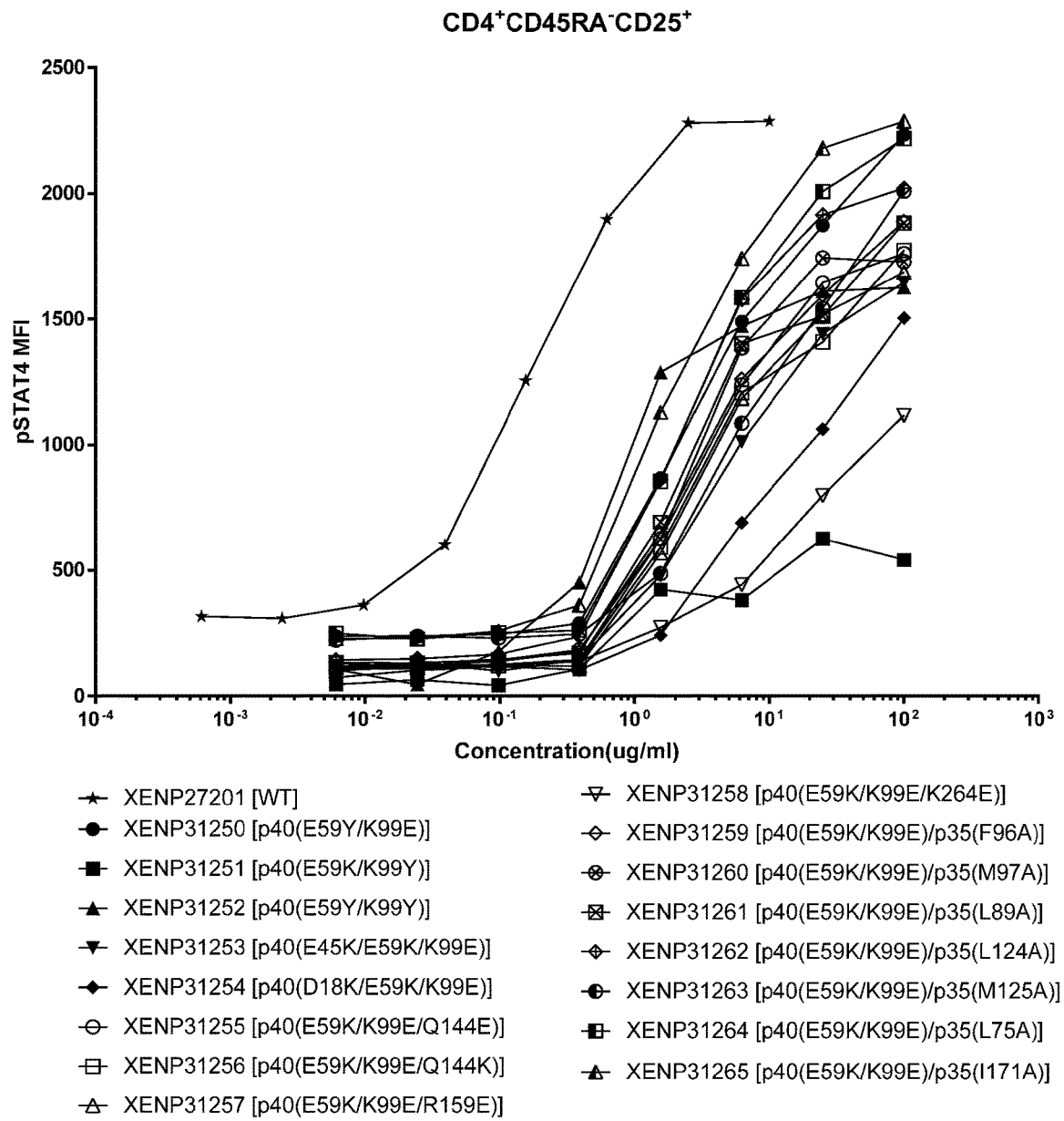
Figure 46C:
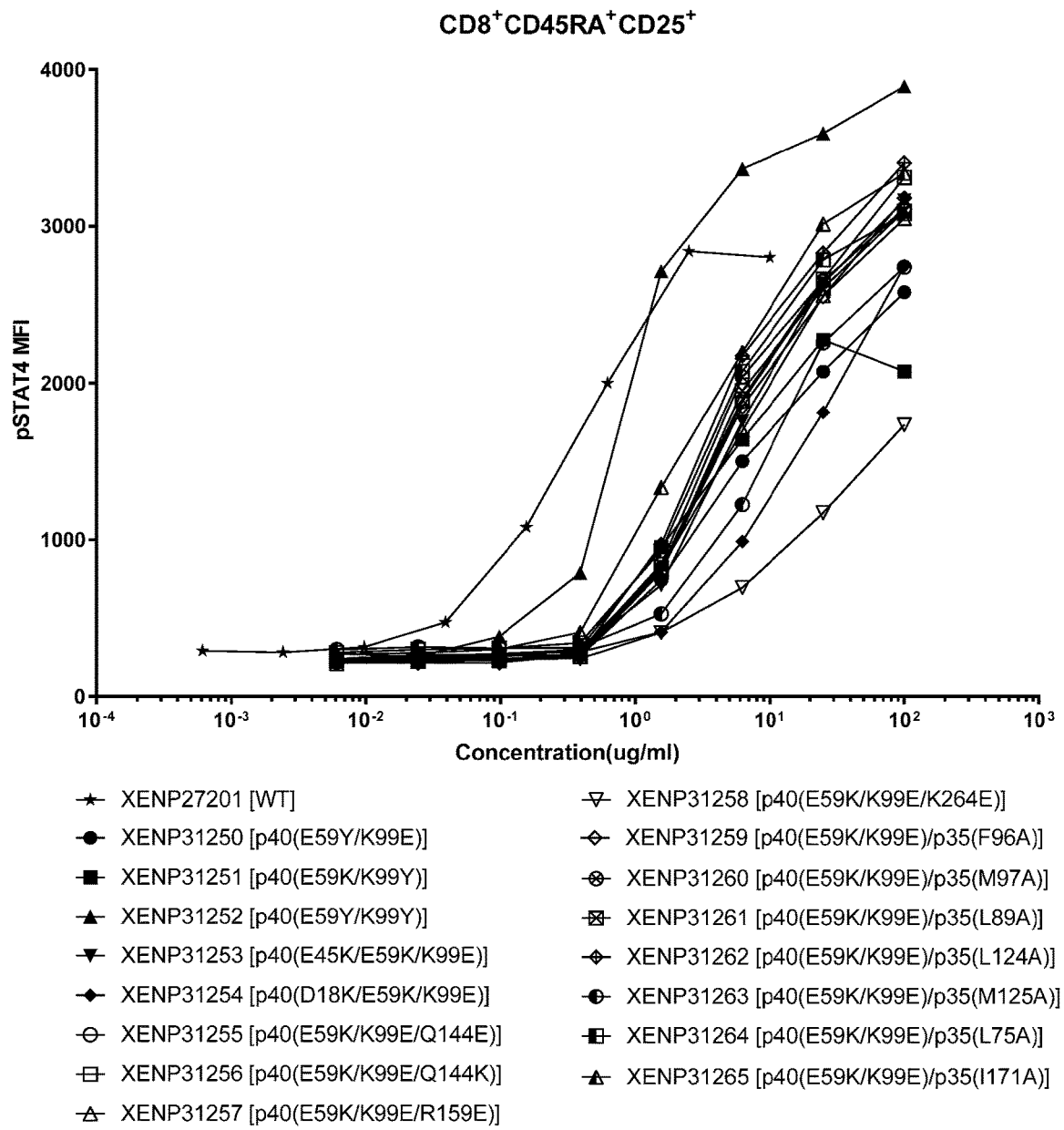
Figure 46D:
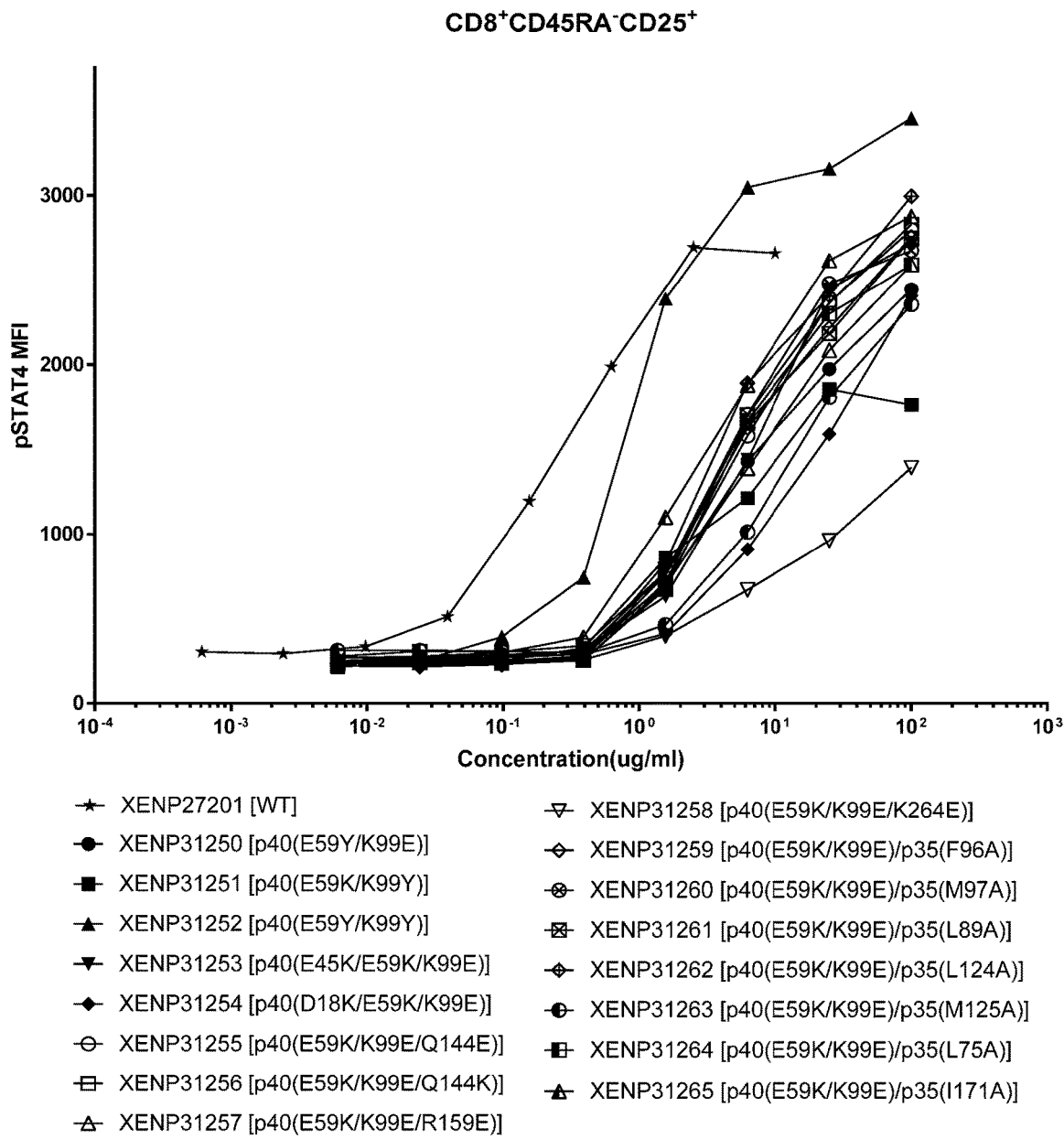
Figure 48A:
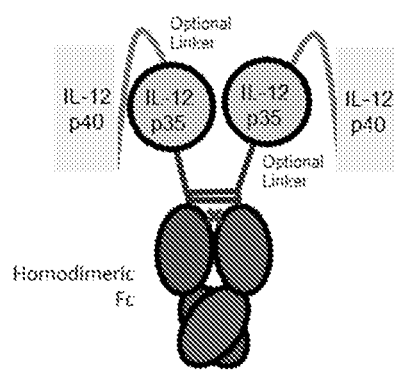
Figure 48B:
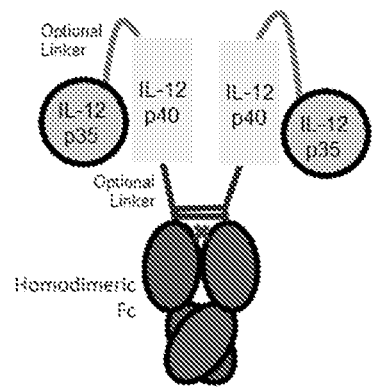
Figure 48C:
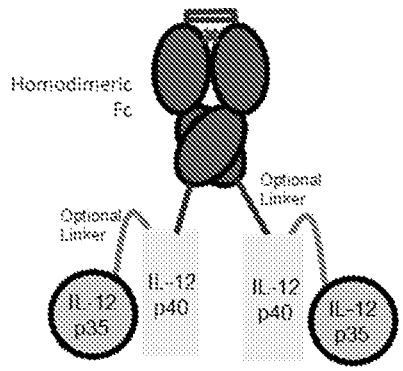
Figure 48D:
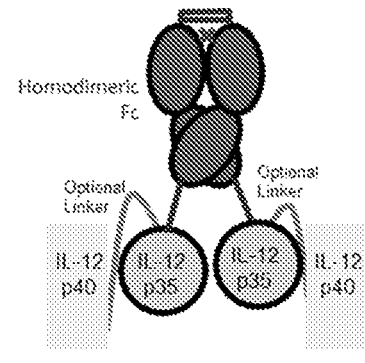
Figure 51A:
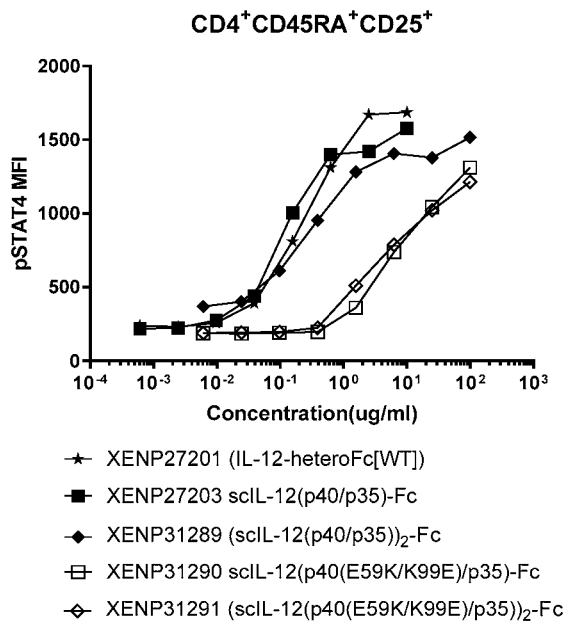
Figure 51B:
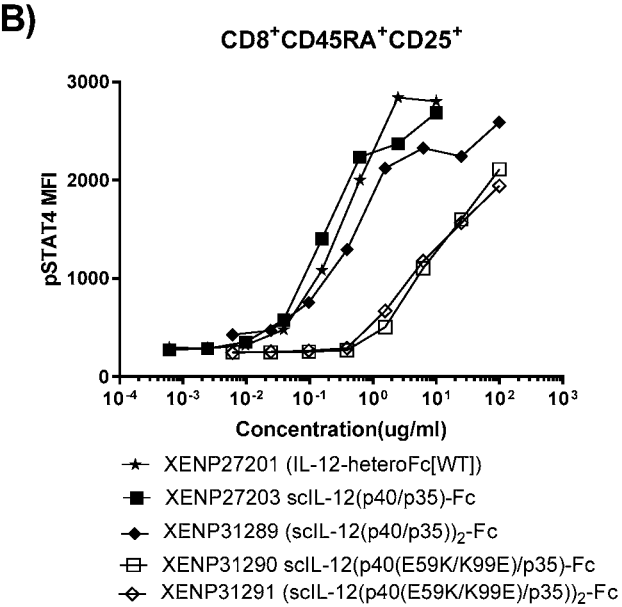
Figure 51C:
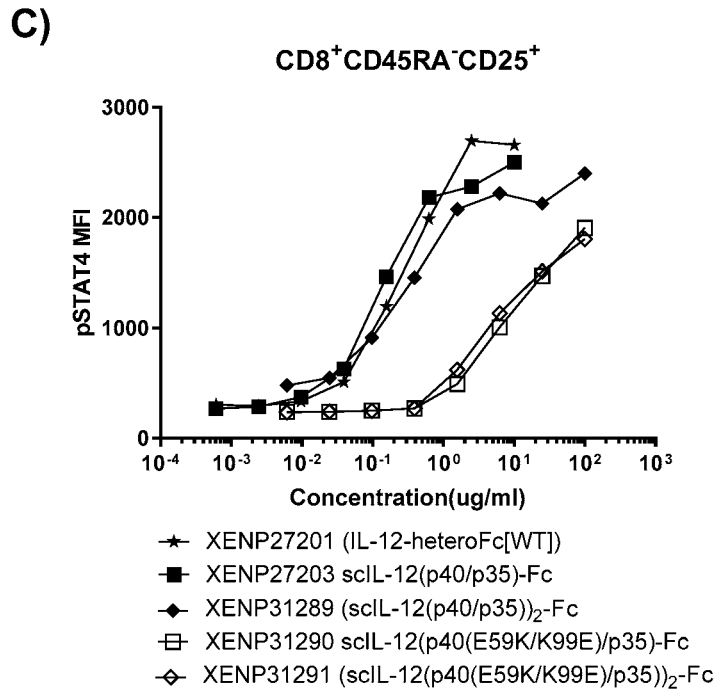
Figure 51D:
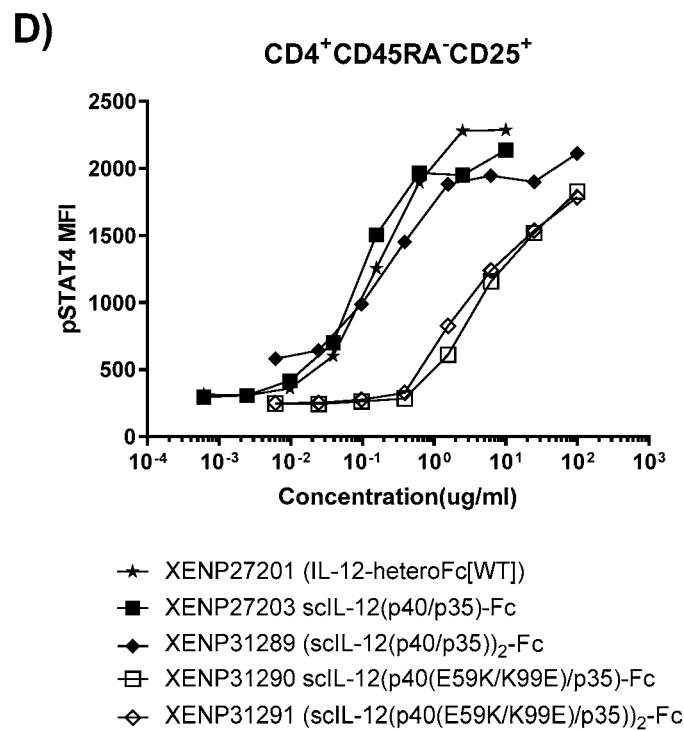
Figure 54A:
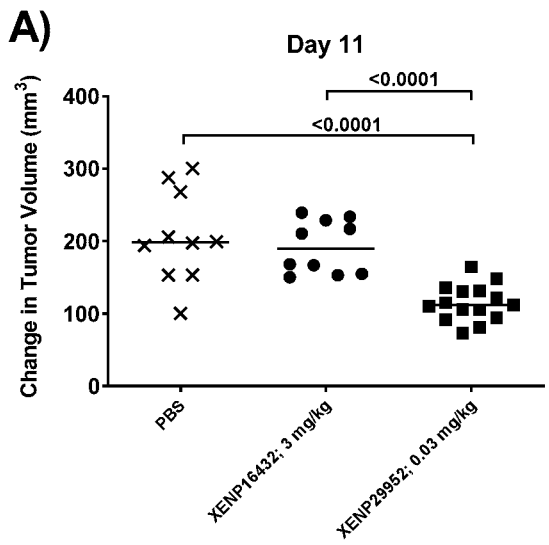
Figure 54B:
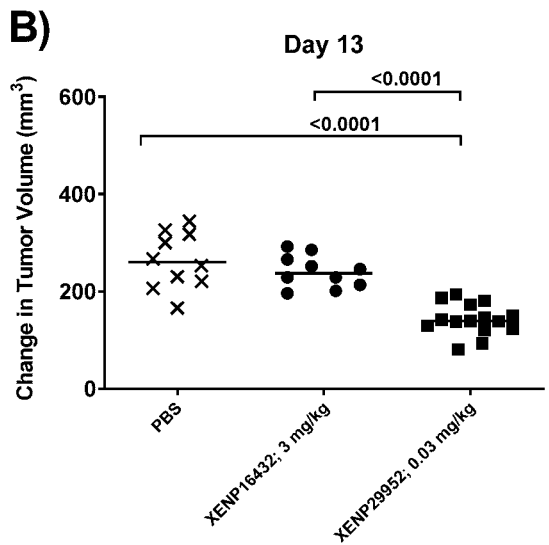
Figure 54C:
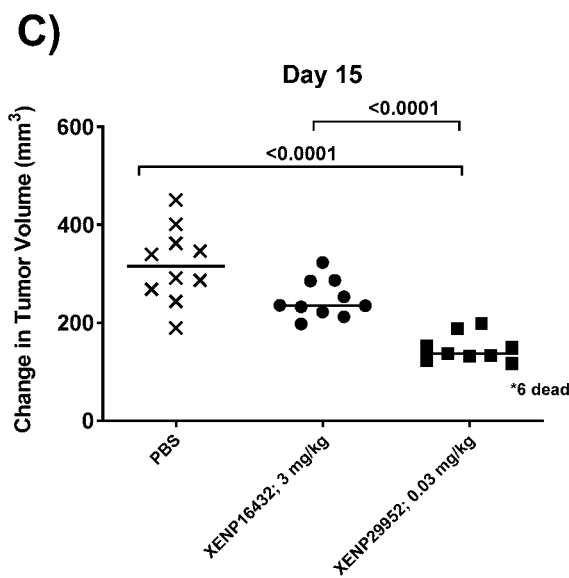
Figure 54D:
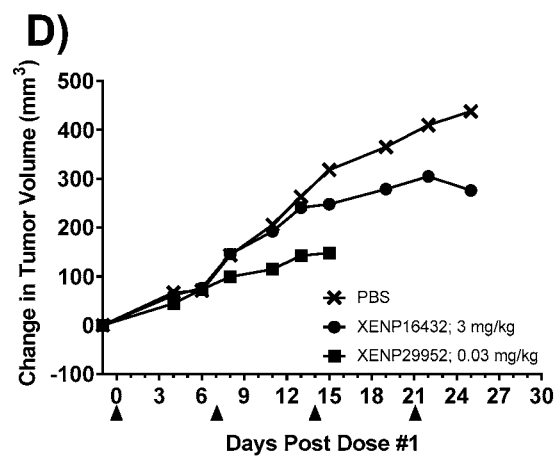
Figure 55A:
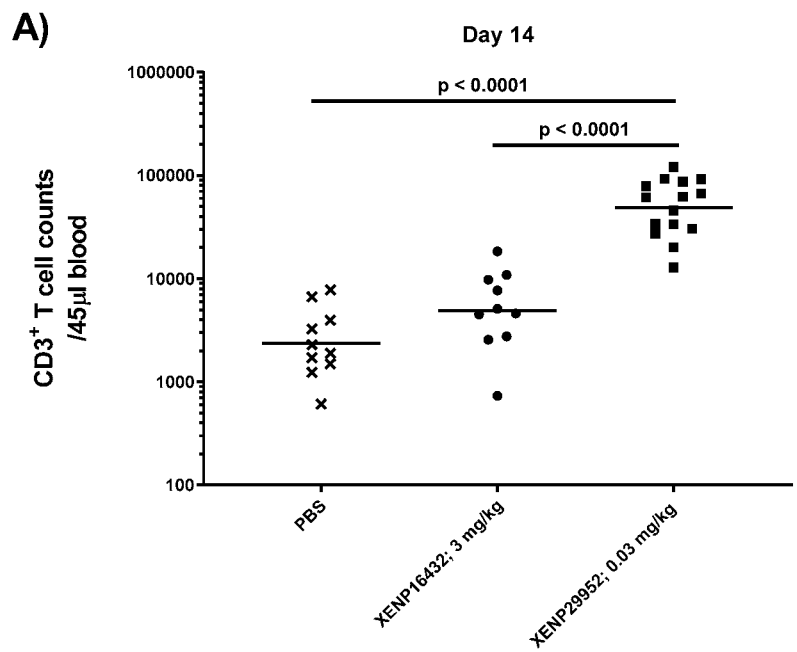
Figure 55B:
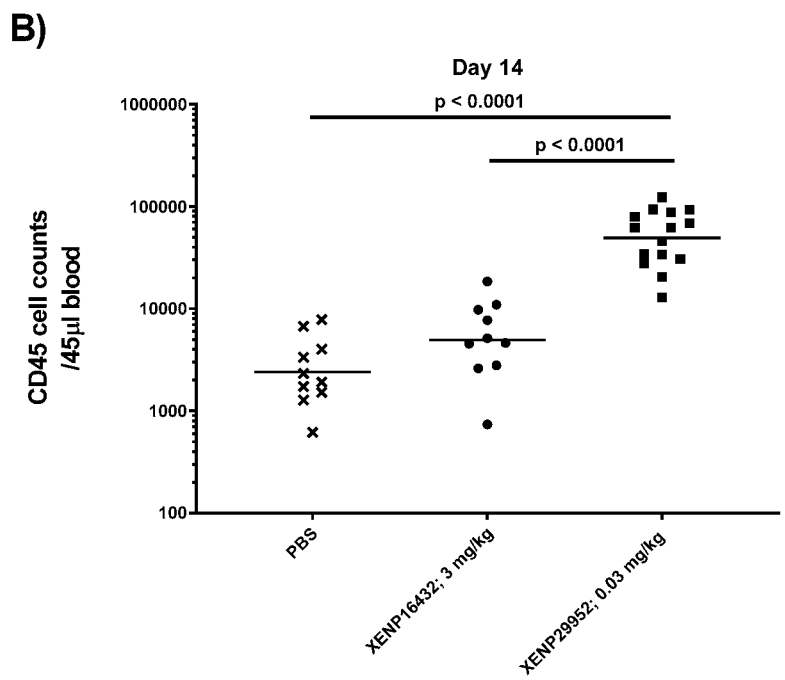
Figure 55C:
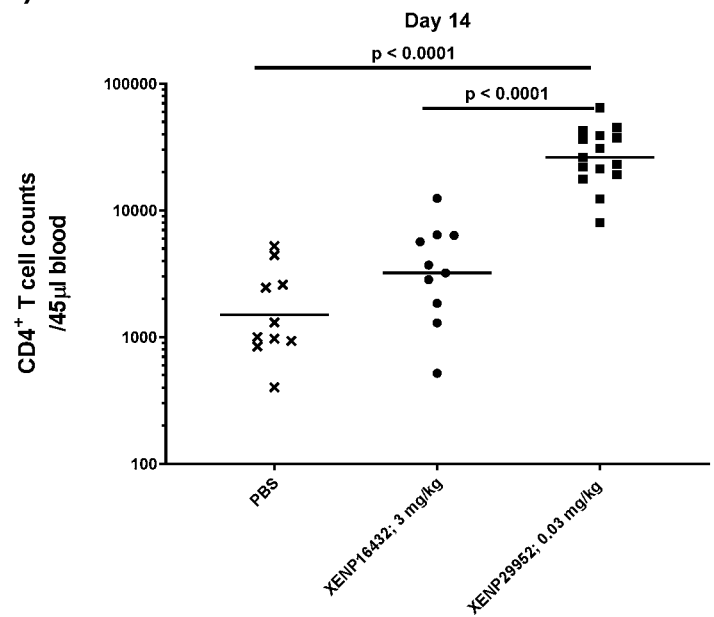
Figure 55D:
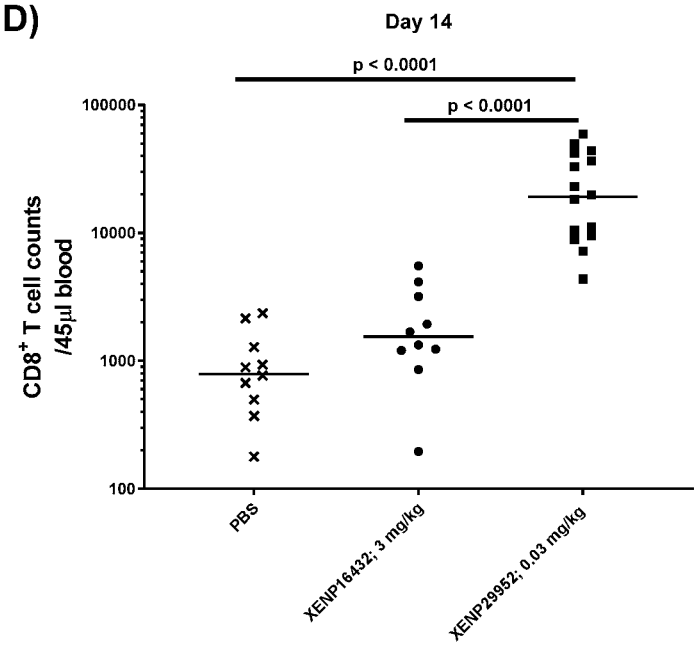
Figure 55E:
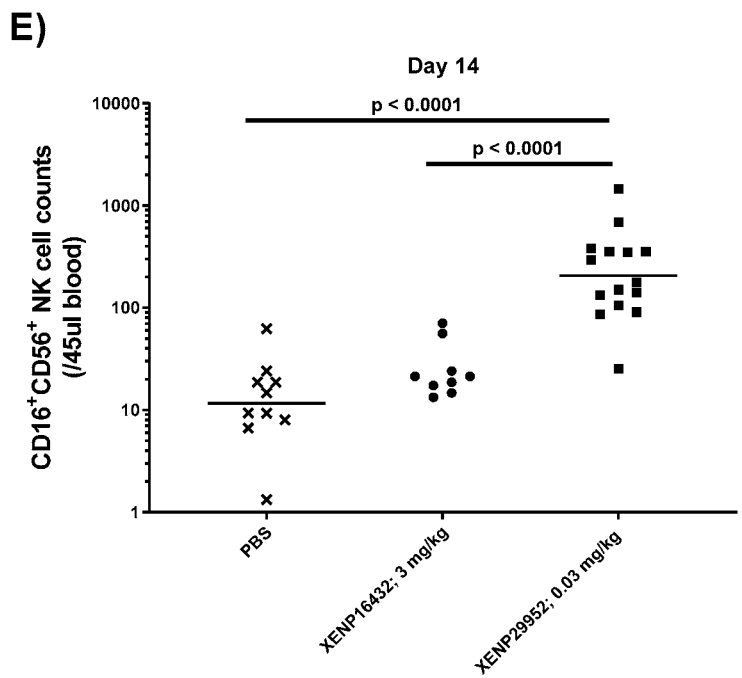
Figure 55F:
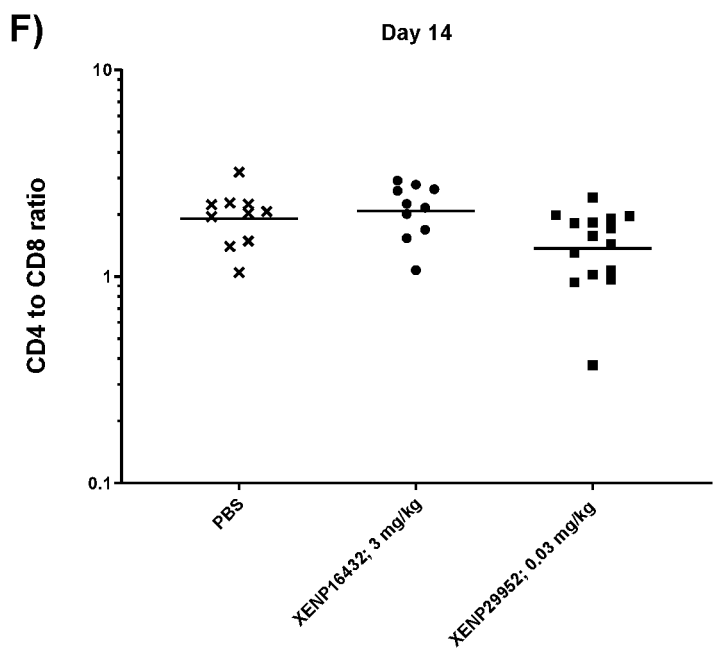
Figure 56A:
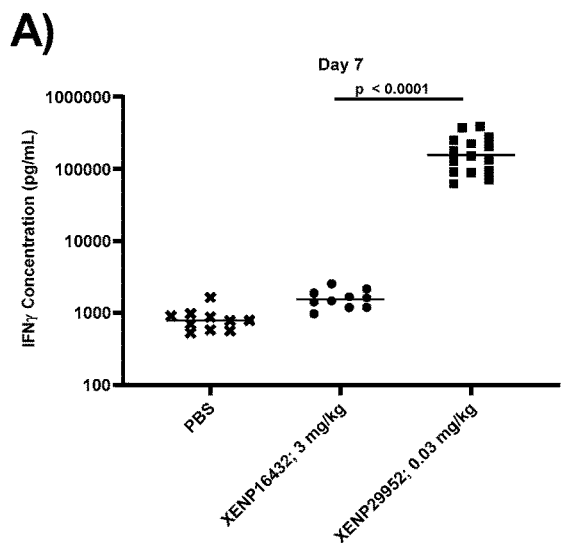
Figure 56B:
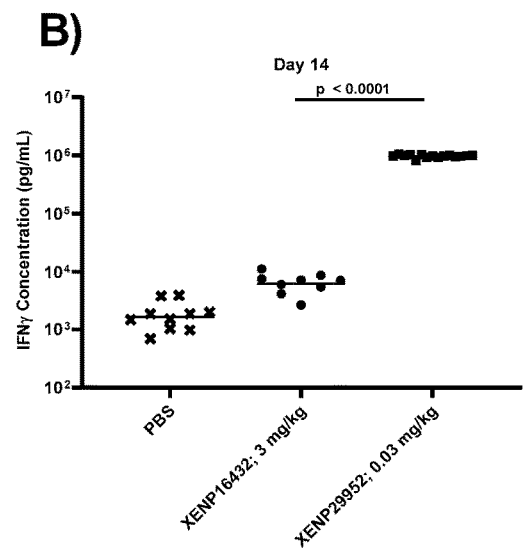
Figure 56C:
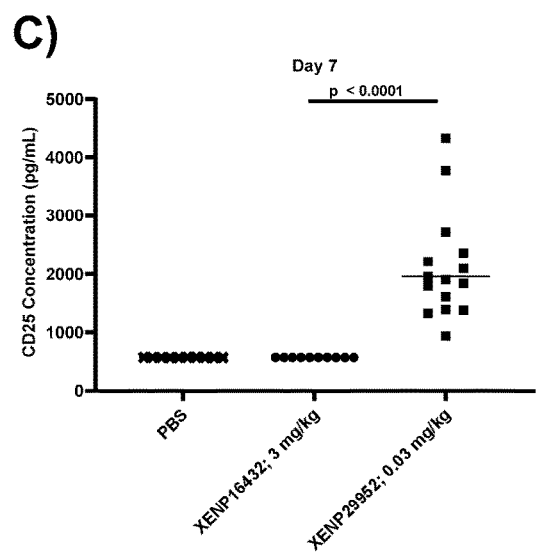
Figure 56D:
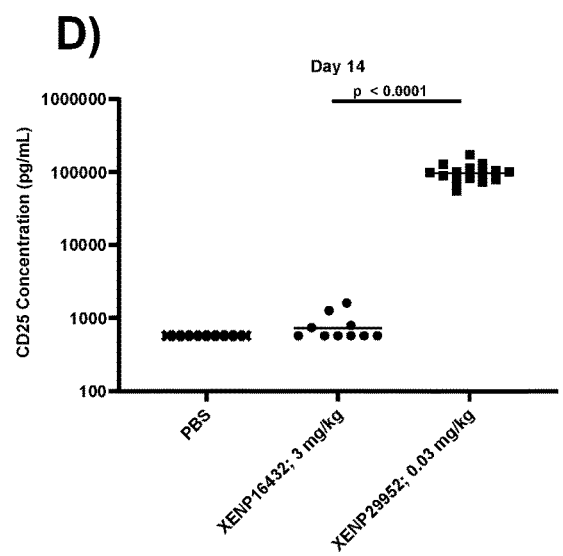
Figure 57A:
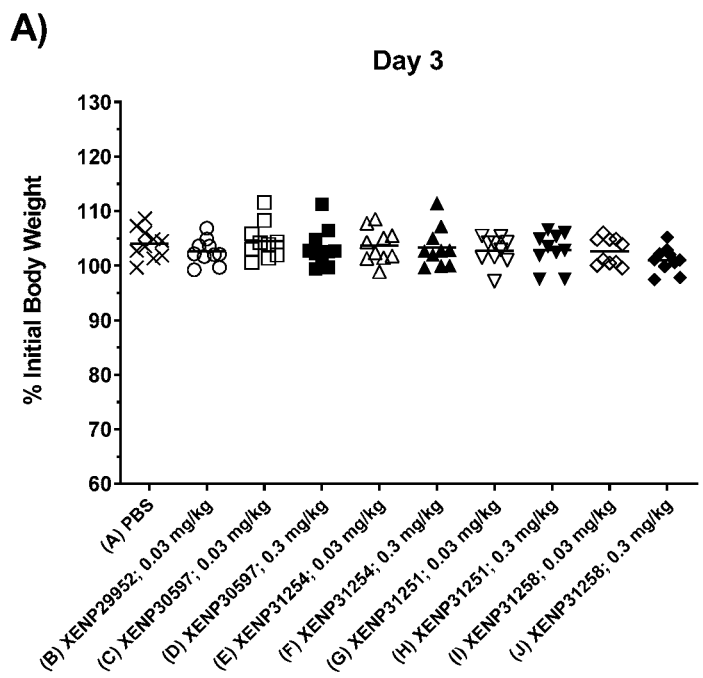
Figure 57B:
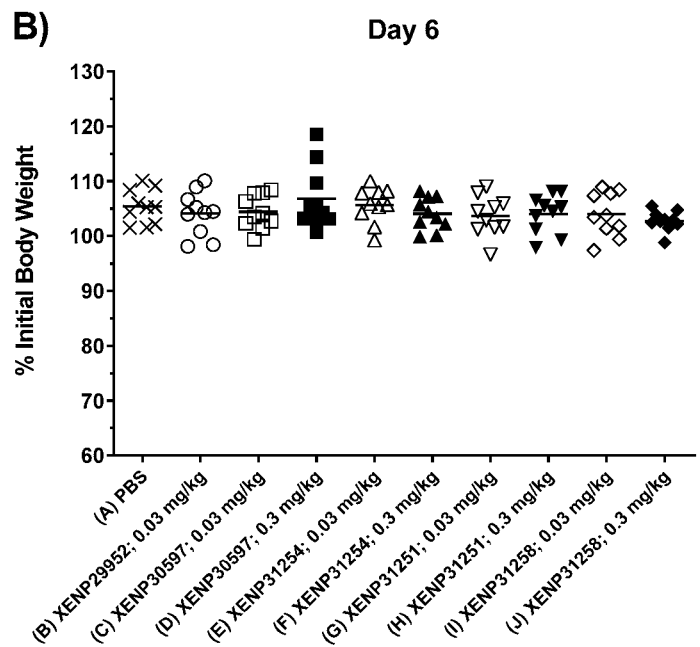
Figure 57C:
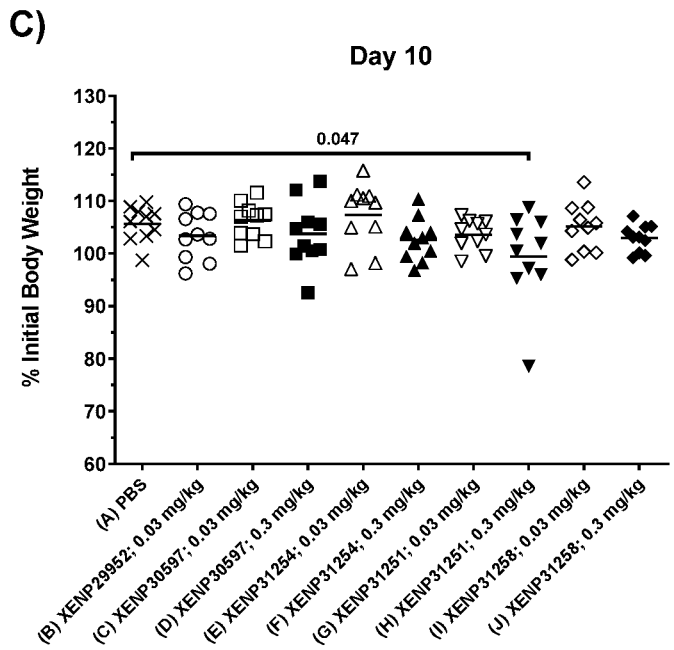
Figure 57D:
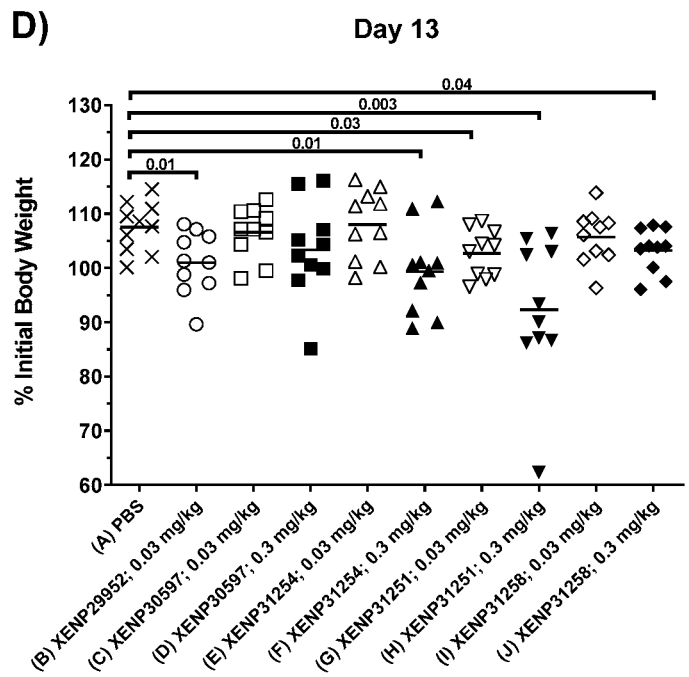
Figure 57E:
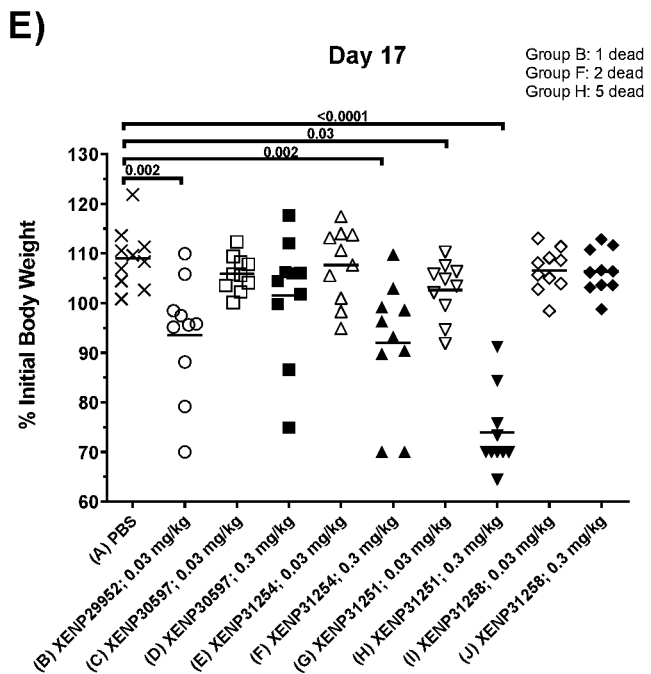
Figure 57F:
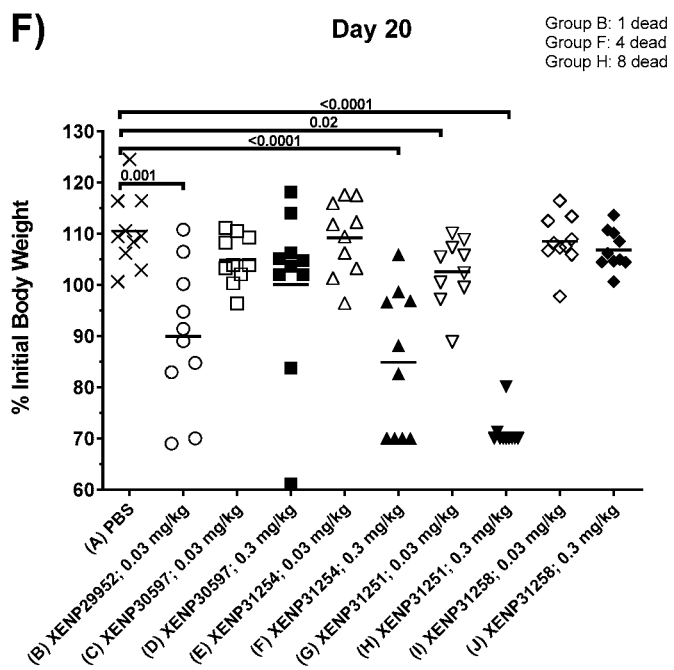
Figure 57G:
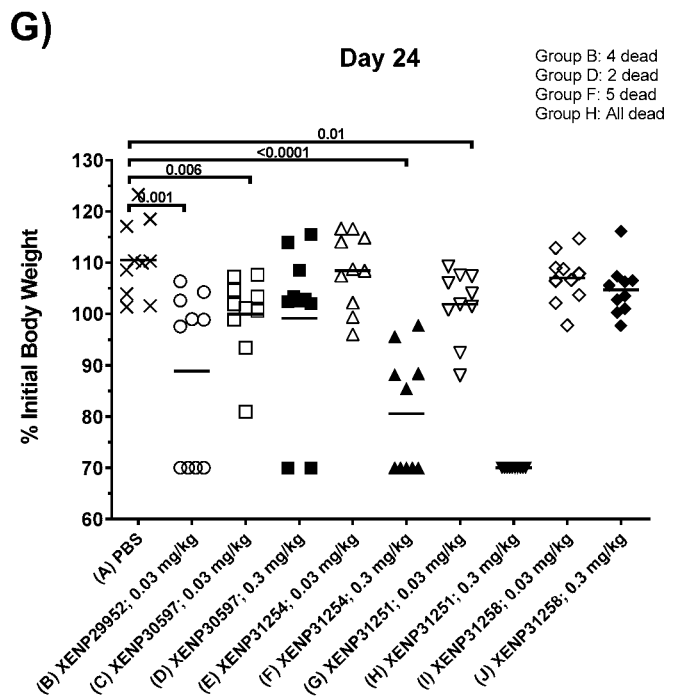
Figure 57H:
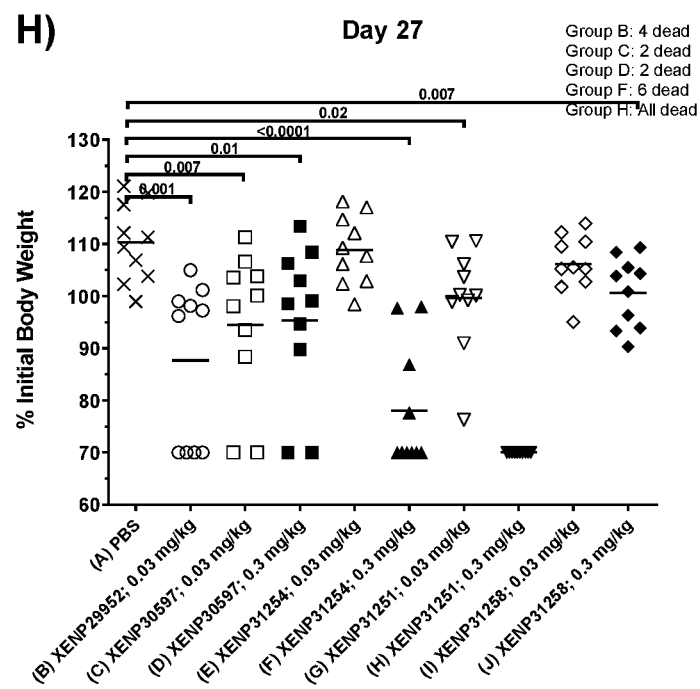
Figure 57I:
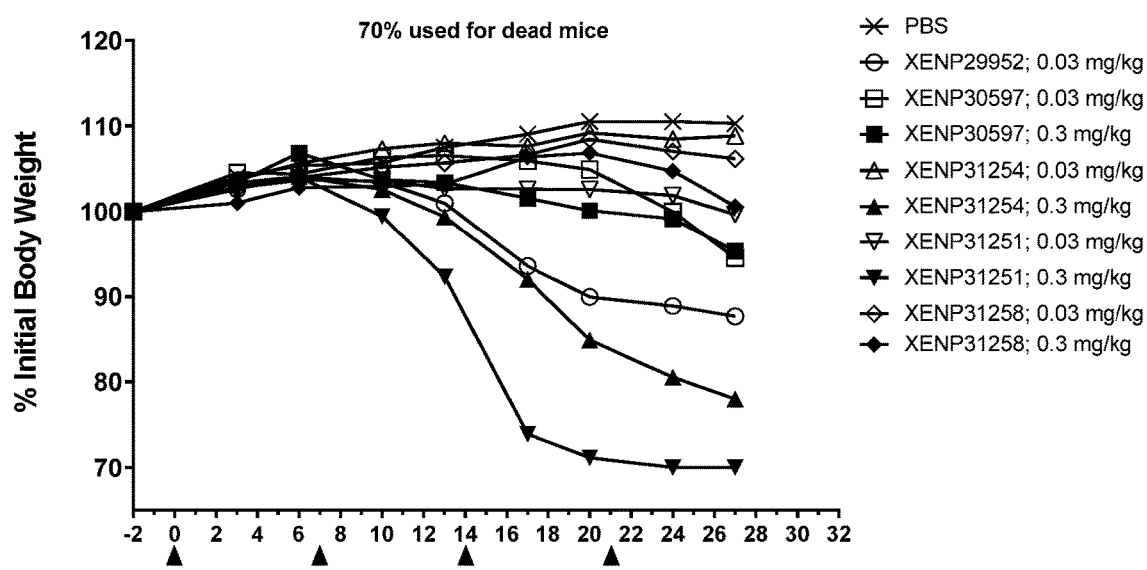
Figure 60A:
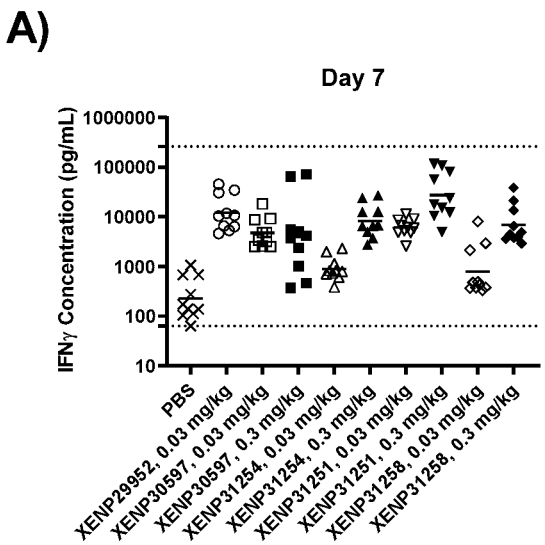
Figure 60B:
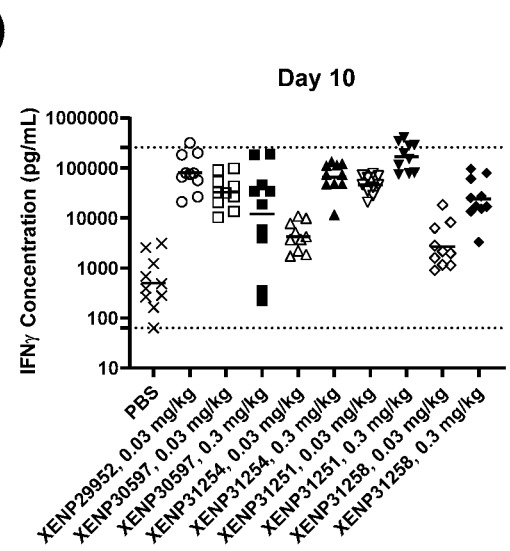
Figure 60C:
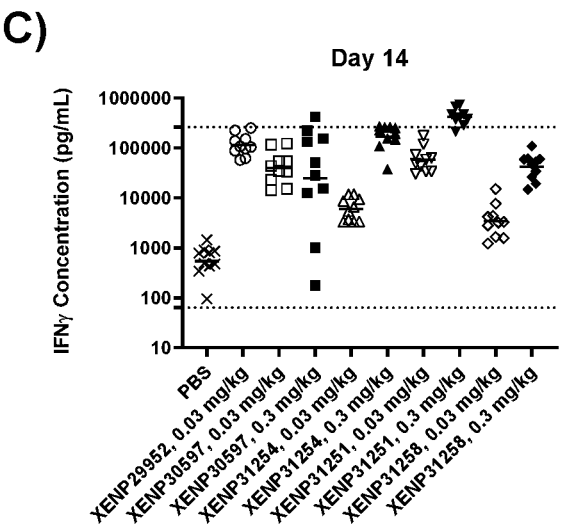
Figure 60D:
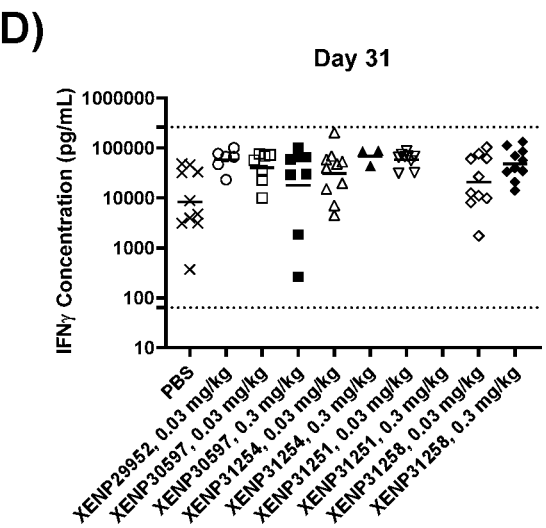
Figure 61G:
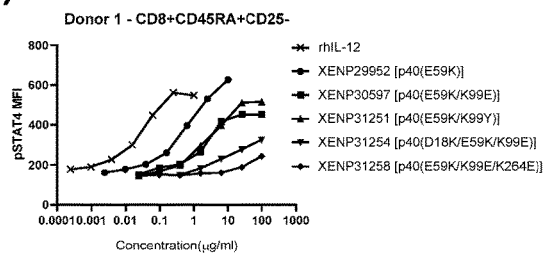
Figure 61H:
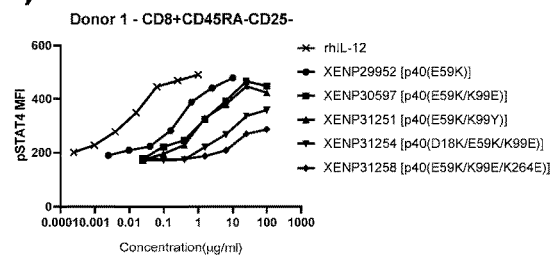
Figure 61I:
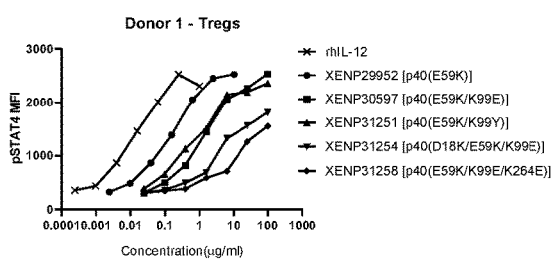
Figure 61J:
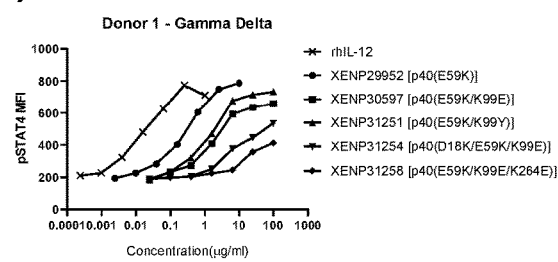
Figure 61K:
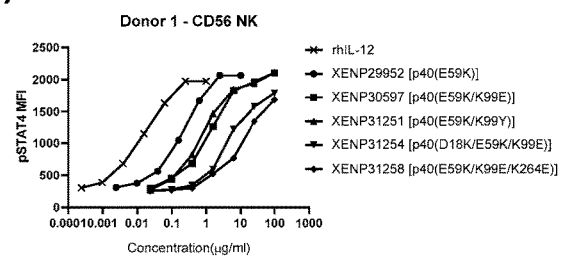
Figure 62A:
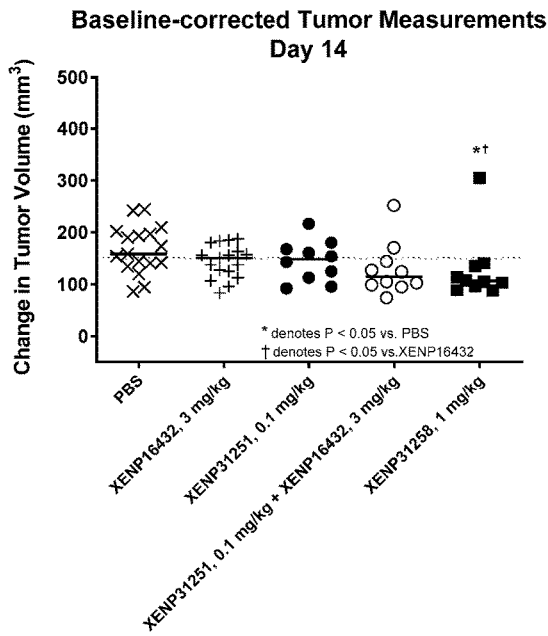
Figure 62B:
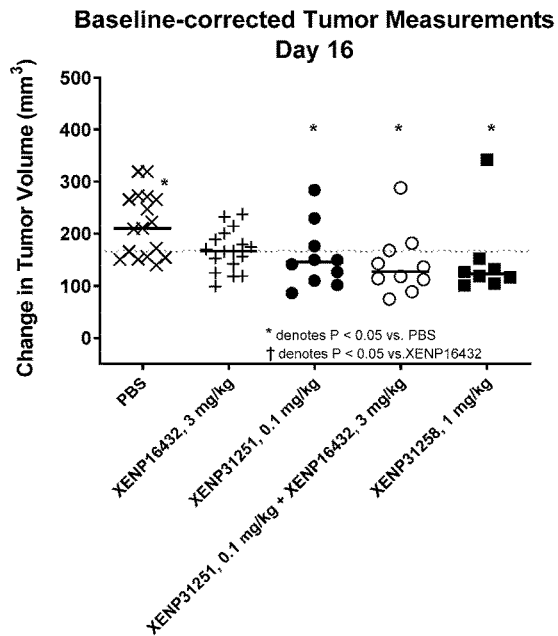
Figure 62C:
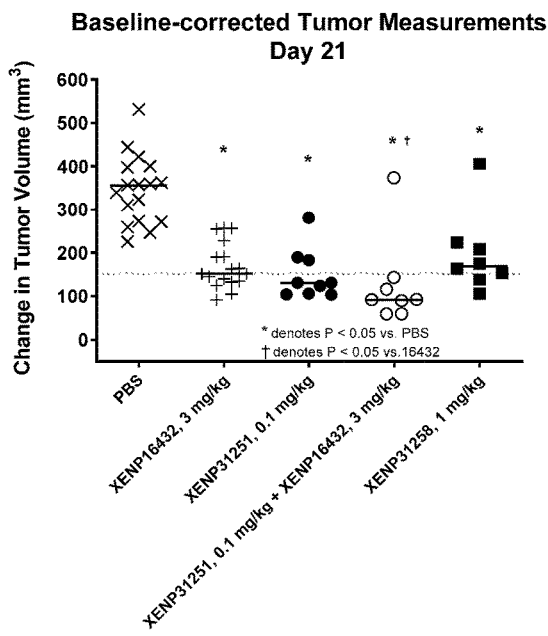
Figure 62D:
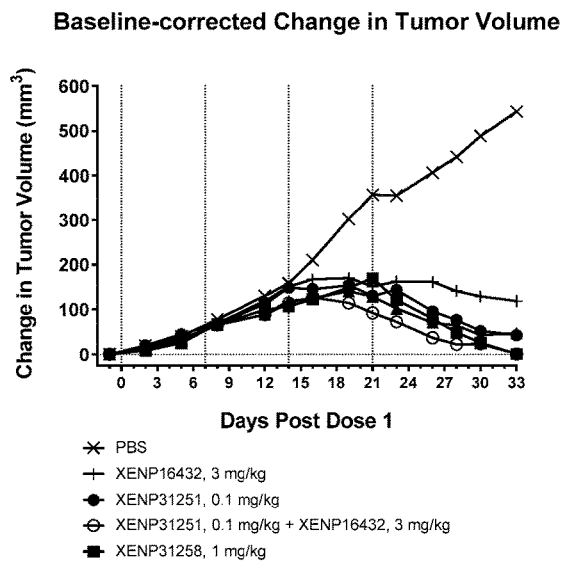
Figure 63A:
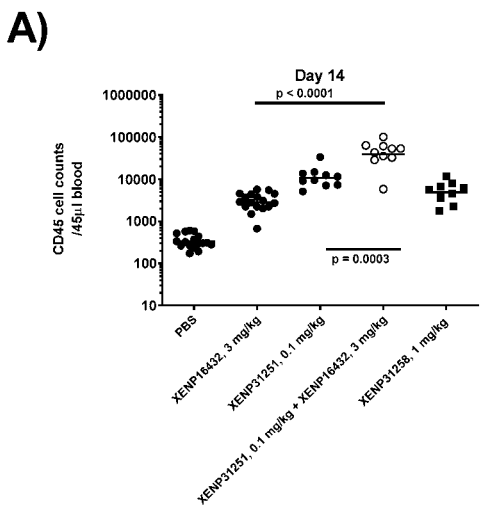
Figure 63B:
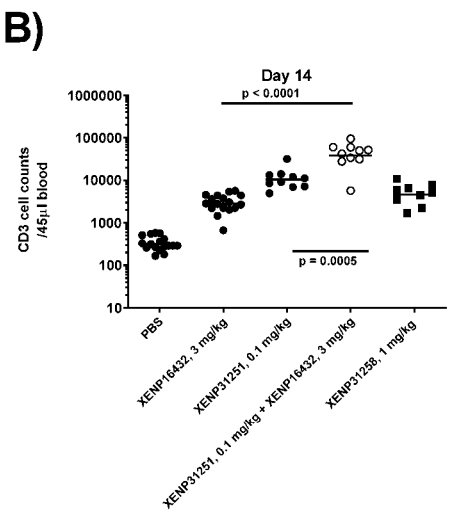
Figure 63C:
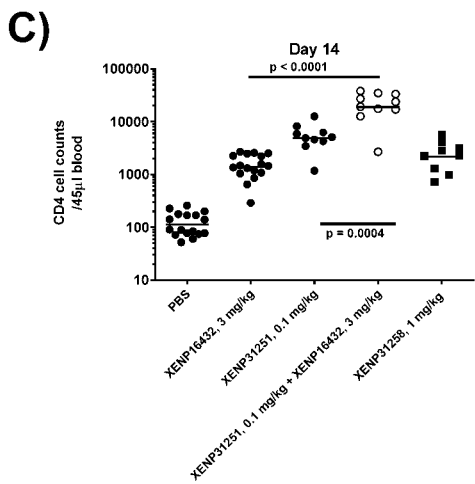
Figure 63D:
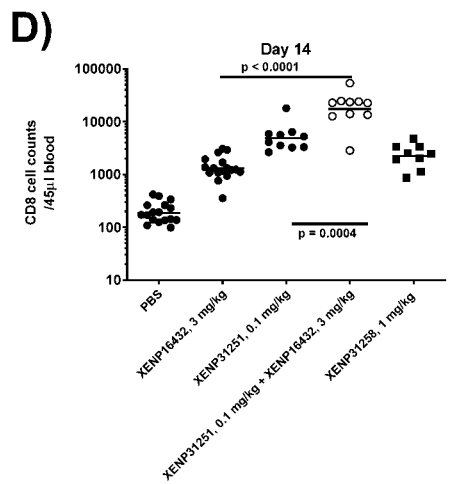
Figure 63E:
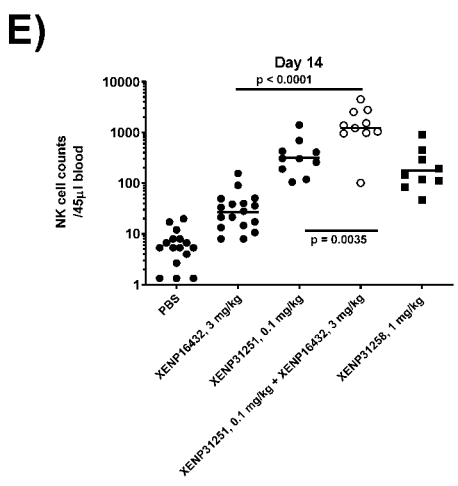
Figure 63F:
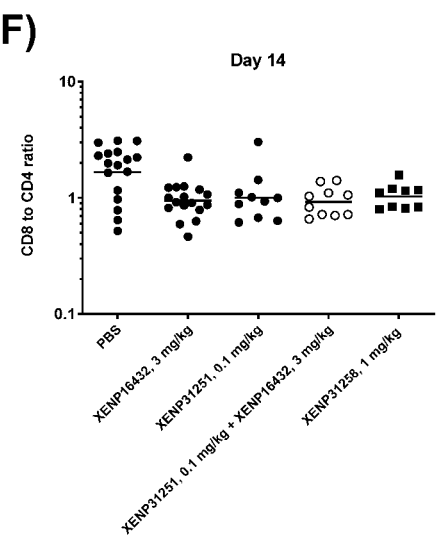
Figure 67A:
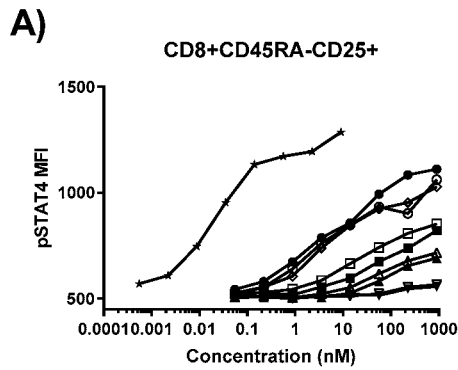
Figure 67B:
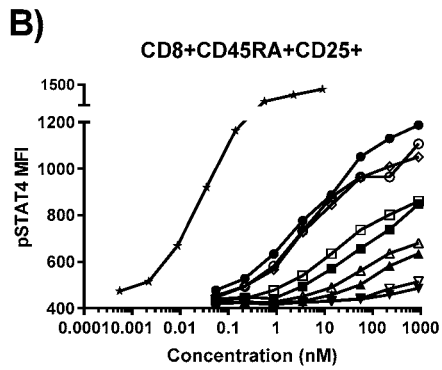
Figure 67C:
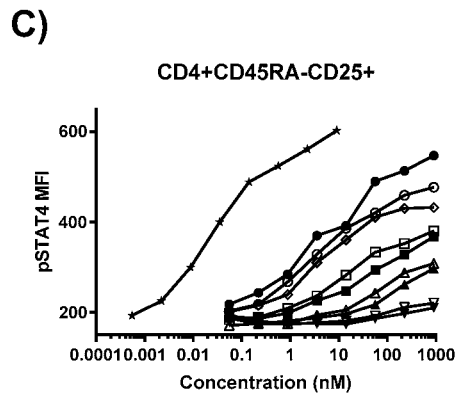
Figure 67C:
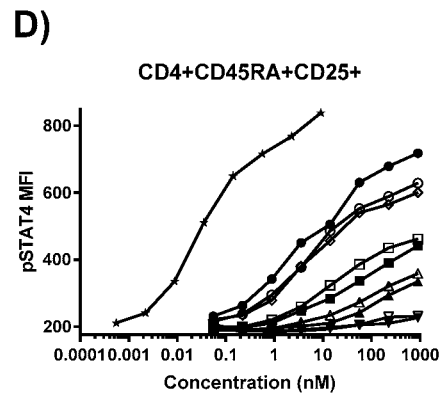
Figure 67D:
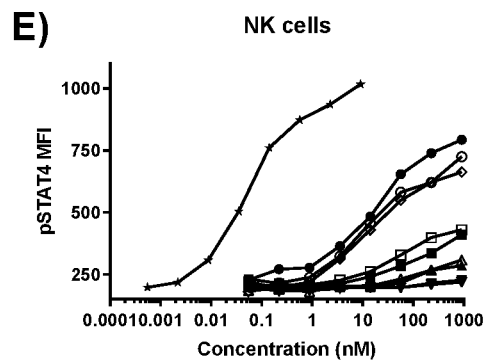

FIG. 40A-40B depicts STAT4 phosphorylation on A) CD4+CD45RA+CD25+ T cells and B) CD8+CD45RA+CD25+ T cells following incubation of activated PBMCs with IL-12-Fc fusions comprising Il-12p40 and/or IL-12p35 variants engineered with an aim to reduce affinity and potency.

FIG. 41 depicts the EC50 (for STAT4 phosphorylation) of IL-12-Fc fusions comprising IL-12p40 and/or IL-12p35 variants and the fold decrease in EC50 relative to WT IL-12-Fc XENP27201. The data show that potency was reduced by up to 100-fold.

FIG. 42A-42B depicts sequences for illustrative IL-12p40 variants designed with the view to reduce the affinity of the IL-12 heterodimeric complex for the IL-12 receptors. Modified amino acids are underlined and in bold.

FIG. 43 depicts sequences for illustrative IL-12p35 variants designed with the view to reduce the affinity of the IL-12 heterodimeric complex for the IL-12 receptors. Modified amino acids are underlined and in bold.

FIG. 44A-44K depicts sequences for illustrative variant IL-12-Fc fusions designed with the view to reduce the affinity of the IL-12-Fc fusions for IL-12 receptors. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 45A-45C depicts sequences for illustrative variant IL-12-Fc fusions designed with the view to reduce the affinity of the IL-12-Fc fusions for IL-12 receptors, further engineered with Xtend Fc (M428L/N434S) for extending half-life. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions. It should be noted that these sequences are provided for illustrative purposes, and that any of the sequences depicted in the other Figures may also include Xtend Fc (M428L/N434S) for extending half-life.

FIG. 46A-46D depict STAT4 phosphorylation on A) CD4+CD45RA+CD25+ T cells, B) CD4+CD45RA−CD25+ T cells, C) CD8+CD45RA+CD25+ T cells, and D) CD8+CD45RA−CD25+ T cells following incubation of activated PBMCs with IL-12-Fc fusions comprising IL-12p40 and/or IL-12p35 variants engineered with an aim to reduce affinity and potency.

FIG. 47 depicts the EC50 (for STAT4 phosphorylation) of IL-12-Fc fusions comprising IL-12p40 and/or IL-12p35 variants and the fold decrease in EC50 relative to WT IL-12-Fc XENP27201.

FIGS. 48A-48D depict illustrative formats for bivalent IL-12-Fc fusion proteins of the present invention. The bivalent N-terminal single-chain (FIGS. 48A-B) format comprises two identical monomers each comprising a scIL-12 complex recombinant fused to the N-terminus of a homodimeric Fc chain (optionally via a domain linker). The bivalent C-terminal single-chain (FIGS. 48C-D) format comprises two identical monomers each comprising a scIL-12 complex recombinant fused to the C-terminus of a homodimeric Fc chain (optionally via a domain linker). The scIL-12 complex can comprise either IL-12p35 N-terminally linked to IL-12p40 or IL-12p40 N-terminally linked to IL-12p35, optionally with a domain linker. The order of the two subunits in the scIL-12 complex may be designated as follows: "scIL-12(p40/p35)", wherein the IL-12p40 subunit is N-terminally linked to the IL-12p35 subunit, or "scIL-12(p35/p40)", wherein the IL-12p35 is N-terminally linked to the IL-12p40 subunit.

FIG. 49 depicts the sequences for XENP31289 and XENP31291, illustrative IL-12-Fc fusion proteins of the (scIL-12(p40/p35))$_2$-Fc format. XENP31289 contains the wild-type IL-12p40 and wild-type IL-12p35 subunits. XENP31291 contains the IL-12p40(E59K/K99E) variant and wild-type IL-12p35 subunits. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 50 depicts the sequences for XENP31290, an illustrative IL-12-Fc fusion protein of the scIL-12(p40/p35)-Fc format, that contains the IL-12p40(E59K/K99E) variant and wild-type IL-12p35 subunits. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIGS. 51A-51D depict STAT4 phosphorylation on A) CD4+CD45RA+CD25+ T cells, B) CD4+CD45RA−CD25+ T cells, C) CD8+CD45RA−CD25+ T cells, and D) CD8+CD45RA−CD25+ T cells following incubation of activated PBMCs with IL-12-Fc fusions in the scIL-12(p40/p35)-Fc and (scIL-12(p40/p35))$_2$-Fc formats with either WT IL-12p40 subunits or variant IL-12p40(E59K/K99E) subunits. The data show that the IL-12-Fc fusions in scIL-12 (p40/p35)-Fc and (scIL-12(p40/p35))$_2$-Fc fusions comprising variant IL-12p40(E59K/K99E) subunits demonstrated reduced potency relative to IL-12-Fc fusions comprising WT IL-12p40 subunits.

FIG. 52 depicts the EC50 (for STAT4 phosphorylation) of IL-12-Fc fusions in the scIL-12(p40/p35)-Fc and (scIL-12 (p40/p35))$_2$-Fc formats with either WT IL-12p40 subunits or variant IL-12p40(E59K/K99E) subunits.

FIG. 53 depicts the sequences for XENP16432, anti-PD-1 mAb based on nivolumab and IgG1 backbone with E233P/L234V/L235A/G236del/S267K ablation variant.

FIGS. 54A-54D depict the change in tumor volume (as determined by caliper measurements) on A) Day 11, B) Day 13, and C) Day 15 as well as D) over time in pp65-MCF7 and huPBMC-engrafted NSG mice dosed with PBS, XENP16432 (a bivalent anti-PD-1 mAb), or XENP29952 (a reduced potency IL-12-Fc fusion in the IL-12-heteroFc format comprising variant IL-12p40(E59K)). XENP29952 significantly enhanced anti-tumor activity by Day 11 as indicated by change in tumor volume (statistics performed on baseline corrected data using unpaired t-test).

FIGS. 55A-55F depict A) CD45 cell, B) CD3$^+$ T cell, C) CD4$^+$ T cell, D) CD8$^+$ T cell, E) NK cell counts as well as F) CD4$^+$ T cell to CD8$^+$ T cell ratio in pp65-MCF7 and huPBMC-engrafted NSG mice on Day 14 following PBMC-engraftment and first dose of PBS, XENP16432 (a bivalent anti-PD-1 mAb), or XENP29952 (a reduced potency IL-12-Fc fusion in the IL-12-heteroFc format comprising variant IL-12p40(E59K)). XENP29952 had significantly enhanced expansion of CD45$^+$, CD3$^+$ T cells, CD4$^+$ T cells, CD8$^+$ T cells, and NK cells by Day 14 in comparison to both PBS control and checkpoint blockade by XENP16432 (statistics performed on log-transformed data using unpaired t-test).

FIGS. 56A-56D depict serum IFNγ concentrations on A) Day 7 and B) Day 14, and serum CD25 concentrations on C) Day 7 and D) Day 14 in pp65-MCF7 and huPBMC-engrafted NSG mice following PBMC-engraftment and first dose of PBS, XENP16432 (a bivalent anti-PD-1 mAb), or XENP29952 (a reduced potency IL-12-Fc fusion in the IL-12-heteroFc format comprising variant IL-12p40 (E59K)). XENP29952 significantly enhanced secretion of IFNγ and CD25 by Day 7 in comparison to checkpoint blockade by XENP16432 (statistics performed on log-transformed date using unpaired t-test).

FIGS. 57A-57I depict change in body weight (as an indicator of GVHD) by A) Day 3, B) Day 6, C) Day 10, D) Day 13, E) Day 17, F) Day 20, G) Day 24, and H) Day 27, as well as I) over time in huPBMC-engrafted NSG mice dosed with PBS or XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying degrees of GVHD which correlated with their in vitro potency. Additionally, the data show a dose response for the test articles (i.e. enhanced GVHD by 0.3 mg/kg vs. 0.03 mg/kg).

FIGS. 58A-58C depict PD-1 expression on CD8$^+$ T cells (as an indicator of activation) in huPBMC-engrafted NSG mice on A) Day 7, B) Day 10, and C) Day 14 following PBMC-engraftment and first dose of PBS or XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying degrees of CD8$^+$ T cell activation which correlated with their in vitro potency. Additionally, the data show a dose response for the test articles (i.e. enhanced CD8$^+$ T cell activation by 0.3 mg/kg vs. 0.03 mg/kg).

FIGS. 59A-59C depict PD-1 expression on CD4$^+$ T cells (as an indicator of activation) in huPBMC-engrafted NSG mice on A) Day 7, B) Day 10, and C) Day 14 following PBMC-engraftment and first dose of PBS or XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying degrees of CD4$^+$ T cell activation which correlated with their in vitro potency. Additionally, the data show a dose response for the test articles (i.e. enhanced CD4$^+$ T cell activation by 0.3 mg/kg vs. 0.03 mg/kg).

FIGS. 60A-60D depict serum concentration of IFNγ in huPBMC-engrafted NSG mice on Days A) 7, B) 10, C) 14 and D) 31 following PBMC-engraftment and first dose of PBS or XENP29952 (a reduced potency IL-12-Fc fusion in the IL-12-heteroFc format comprising variant IL-12p40 (E59K)), XENP30597 (a reduced potency IL-12-Fc fusion in the IL-12-heteroFc format comprising variant IL-12p40 (E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying levels of IFNγ secretion which correlated with their in vitro potency. Additionally, the data show a dose response for the test articles (i.e. enhanced IFNγ secretion induced by 0.3 mg/kg vs. 0.03 mg/kg).

FIGS. 61A-61K depict STAT4 phosphorylation on A) CD4$^+$CD45RA$^-$CD25$^+$ T cells, B) CD4$^+$CD45RA$^+$CD25$^+$ T cells, C) CD4$^+$CD45RA$^+$CD25– T cells, D) CD4$^+$CD45RA$^-$CD25$^-$ T cells, E) CD8$^+$CD45RA$^-$CD25$^+$ T cells, F) CD8$^+$CD45RA$^+$CD25$^+$ T cells, G) CD8$^+$CD45RA$^-$CD25$^-$ T cells, H) CD8$^+$CD45RA$^-$CD25$^-$ T cells, I) Tregs, J) γδ T cells, and K) CD56$^+$ NK cells following incubation of activated PBMCs (from a first donor; Donor 1) with recombinant human IL-12, XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/

K99E/K264E)). The data show a potency ladder with XENP29952 as the most potent variant, XENP31254 and XENP31258 as the least potent variants, and XENP30597 and XENP31251 falling in between. Notably, the degree of GVHD and T cell activation as induced by the reduced potency IL-12-Fc fusion variants in vivo correlated with the in vitro potency.

FIGS. 62A-62D depict the change in tumor volume (as determined by caliper measurements) on A) Day 14, B) Day 16, and C) Day 21 as well as D) over time in pp65-MCF7 and huPBMC-engrafted NSG mice dosed with PBS, XENP16432 (a bivalent anti-PD-1 mAb), XENP31258, XENP31251, or a combination of XENP31251 and XENP16432. XENP31258 significantly enhanced anti-tumor activity by Day 14, XENP31251 (alone or in combination with XENP16432) significantly enhanced anti-tumor activity by Day 16 in comparison to treatment with PBS; and XENP31251 in combination with XENP16432 significantly enhanced anti-tumor activity by Day 21 in comparison to treatment with XENP16432 alone (statistics performed on baseline corrected data using Mann-Whitney test).

FIGS. 63A-63F depict A) CD45 cell, B) CD3$^+$ T cell, C) CD4$^+$ T cell, D) CD8$^+$ T cell, E) NK cell counts as well as F) CD8$^+$ T cell to CD4$^+$ T cell ratio in pp65-MCF7 and huPBMC-engrafted NSG mice on Day 14 following PBMC-engraftment and first dose of PBS, XENP16432 (a bivalent anti-PD-1 mAb), XENP31258, XENP31251, or a combination of XENP31251 and XENP16432. Notably, the data show that treatment with XENP31251 in combination with XENP16432 significantly enhanced lymphocyte expansion in comparison to either XENP31251 or XENP16432 alone, indicating that IL-12-Fc fusions combine productively with checkpoint blockade.

FIGS. 64A-64C depict sequences for illustrative variant IL-12-Fc fusions designed with the view to reduce the affinity of the IL-12-Fc fusions for IL-12 receptors, further engineered with Xtend Fc (M428L/N434S) for extending half-life. Linkers are double underlined (although as will be appreciated by those in the art, the linkers can be replaced by other linkers, some of which are depicted in FIG. 6), and slashes (/) indicate the border(s) between Il-12p35, IL-12p40, linkers, and Fc regions. It should be noted that these sequences are provided for illustrative purposes, and that any of the sequences depicted in the other Figures may also include Xtend Fc (M428L/N434S) for extending half-life.

FIGS. 65A-65C depict sequences for illustrative IL-12p40 variants engineered with C252S with the view to remove the free cysteine (in addition to expression and affinity/potency variants).

FIGS. 66A-66Q depict sequences for illustrative variant IL-12-Fc fusions engineered with C252S in the IL-12p40 subunit with the view to remove the free cysteine (in addition to expression and affinity/potency variants). Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIGS. 67A-67D depicts STAT4 phosphorylation on A) CD8$^+$CD45RA$^-$CD25$^+$ T cells, B) CD8$^+$CD45RA$^+$CD25$^+$ T, C) CD4$^+$CD45RA$^-$CD25$^+$ T, D) CD4-CD45RA$^+$CD25$^+$ T, and E) NK cells following incubation of activated PBMCs with IL-12-Fc comprising IL-12p40 variants with or without additional engineering to remove free cysteine. The data show that most of the variants comprising C252S in the IL-12p40 subunit demonstrated similar, albeit slightly improved, potency in comparison to the variants without the C252S modification

DETAILED DESCRIPTION OF THE INVENTION

I. Overview

The present invention is directed to novel heterodimeric fusion protein constructs containing IL-12 subunits and Fc domains. As noted above, IL-12 is composed of an α-chain (the p35 subunit; IL-12p35) and a β-chain (the p40 subunit; IL-12p40) covalently linked to form the biologically active IL-12 heterodimer. IL-12 exerts its cell signaling function through binding by binding to a dimeric IL-12 receptor complex composed of IL-12 receptor β1 (IL-12Rβ1) and IL-12 receptor β2 (IL-12Rβ2) on T cells and inducing IFNγ secretion. However, the IL-12p40 subunit can also exist as a homodimer which has been reported to antagonize IL-12 activity by competing for binding to IL-12 receptor. Accordingly, the present invention addresses the short half-life of IL-12 and the potential formation of antagonistic IL12p40 homodimers by providing IL-12-Fc fusion proteins, as well as novel IL-12 variants with decreased potency. As generally shown in FIG. 8, the heterodimeric fusion proteins of the invention can take on a variety of conformations.

This application incorporates by reference 62/740,813 filed Oct. 3, 2018 and 62/828,512 filed May 15, 2019, more specifically for FIG. 17 in 62/740,813 and FIGS. 62A-62K and FIGS. 63A-63D in 62/828,512 as well as the Figure Legends and the mention of these figures in the corresponding specification.

II. Definitions

In order that the application may be more completely understood, several definitions are set forth below. Such definitions are meant to encompass grammatical equivalents.

By "ablation" herein is meant a decrease or removal of binding and/or activity. Thus for example, "ablating FcγR binding" means the Fc region amino acid variant has less than 50% starting binding as compared to an Fc region not containing the specific variant, with less than 70-80-90-95-98% loss of binding being preferred, and in general, with the binding being below the level of detectable binding in a Biacore assay. Of particular use in the ablation of FcγR binding are those shown in FIG. 4. However, unless otherwise noted, the Fc monomers of the invention retain binding to the FcRn.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y or 272Y refers to a variant polypeptide, in this case an Fc variant, in which the glutamic acid at position 272 is replaced with tyrosine. For clarity, a protein which has been engineered to change the nucleic acid coding sequence but not to change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid residue or sequence at a particular position in a parent polypeptide sequence. For example, –233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid residue or sequence at a particular position in a parent polypeptide sequence. For example, E233-, E233#, E233( ) or E233del designates a deletion of glutamic acid at position 233. Additionally, EDA233- or EDA233# designates a deletion of the sequence GluAspAla that begins at position 233.

By "variant protein", "protein variant", or "variant" as used herein is meant a protein that differs from that of a parent protein by virtue of at least one modification. Protein variant may refer to the protein itself, a composition comprising the protein, the amino acid sequence that encodes it, or the DNA sequence that encodes it. Preferably, the protein variant has at least one amino acid modification compared to the parent protein, e.g. from about one to about seventy amino acid modifications, and preferably from about one to about five amino acid modifications compared to the parent. The modification can be an addition, deletion, or substitution. As described below, in some embodiments the parent polypeptide, for example an Fc parent polypeptide, is a human wild type sequence, such as the Fc region from IgG1, IgG2, IgG3 or IgG4. The protein variant sequence herein will preferably possess at least about 80% identity with a parent protein sequence, and most preferably at least about 90% identity, more preferably at least about 95-98-99% identity.

As used herein, by "protein" is meant at least two covalently attached amino acids, which includes proteins, polypeptides, oligopeptides and peptides. When a biologically functional unit comprises two or more proteins, each protein may be referred to as a "monomer" or as a "subunit" or as a "domain"; and the biologically functional molecule may be referred to as a "complex".

As used herein, by "protein" is meant at least two covalently attached amino acids, which includes proteins, polypeptides, oligopeptides, and peptides. When a biologically functional molecule or complex comprises two or more proteins, each protein may be referred to as a "monomer" or as a "subunit" or as a "domain"; and the biologically functional molecule may be referred to as a "complex" In some embodiments, the two or more proteins of a functional complex are non-covalently attached. In some embodiments, the term "monomer" refers to a polypeptide or protein comprising one or more components, fragments, or subunits of a protein(s), and the components, fragments, or subunits are covalently attached.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

The carboxy-terminal portion of each IgG chain defines a constant region primarily responsible for effector function. Kabat et al. collected numerous primary sequences of the variable regions of heavy chains and light chains. Based on the degree of conservation of the sequences, they classified individual primary sequences into the CDRs and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second heavy chain constant domains of an antibody. Structurally, the IgG CH1 domain ends at EU position 215, and the IgG CH2 domain begins at residue EU position 231. Thus for IgG the antibody hinge is herein defined to include positions 216 (E216 in IgGC) to 230 (P230 in IgGC), wherein the numbering is according to the EU index as in Kabat. In some embodiments, for example in the context of an Fc region, the hinge is included, generally referring to positions 216-230. As noted herein, pI variants can be made in the hinge region as well.

By "non-naturally occurring modification" as used herein is meant an amino acid modification that is not isotypic. For example, because none of the IgGs comprise a serine at position 434, the substitution 434S in IgGC, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" or "Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (efferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin (12-microglobulin) and the heavy chain is encoded by the FcRn gene. Unless otherwise noted herein, FcRn or an FcRn protein refers to the complex of FcRn heavy chain with 132-microglobulin. A variety of Fc variants can be used to increase binding to the FcRn, and in some cases, to increase serum half-life. In general, unless otherwise noted, the Fc monomers of the invention retain binding to the FcRn (and, as noted below, can include amino acid variants to increase binding to the FcRn).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgGC, IgG2, IgG3 or IgG4, with IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminus, wherein the numbering is according to the EU index as in Kabat. In some embodiments, as is more fully described below, amino acid modifications are made to the Fc region, for example to alter binding to one or more FcγR or to the FcRn.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
| --- | --- | --- |
| CH1 | 118-215 | 114-223 |
| Hinge | 216-230 | 226-243 |
| CH2 | 231-340 | 244-360 |
| CH3 | 341-447 | 361-478 |

"Fc variant" or "variant Fc" as used herein is meant a protein comprising an amino acid modification in an Fc domain. The modification can be an addition, deletion, or substitution. The Fc variants of the present invention are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed in the present invention that relate to antibodies or derivatives and fragments thereof, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference). The modification can be an addition, deletion, or substitution.

By "fusion protein" as used herein is meant covalent joining of at least two proteins or protein domains. Fusion proteins may comprise artificial sequences, e.g. a domain linker, variant Fc domains, a variant IL-12p40 subunit domain, a variant IL-12p35 subunit domain, etc. as described herein. By "Fc fusion protein" or "immunoadhesin" herein is meant a protein comprising an Fc region, generally linked (optionally through a domain linker, as described herein) to one or more different protein domains. Accordingly, an "IL-12 Fc fusion" comprises an Fc region linked (optionally but usually through a domain linker) to an IL-12p40 subunit, an IL12p35 subunit and/or single-chain IL-12 complex (scIL-12), as described herein. In some instances, two Fc fusion proteins can form a homodimeric Fc fusion protein or a heterodimeric Fc fusion protein with the latter being preferred in some instances. In some cases, one monomer of the heterodimeric Fc fusion protein comprises an Fc domain alone (e.g., an "empty Fc domain") and the other monomer is an Fc fusion, comprising a variant Fc domain and one or two IL-12 subunit domains, as outlined herein.

By "position" as used herein is meant a location in the sequence of a protein. Positions may be numbered sequentially, or according to an established format, for example the EU index for antibody numbering.

By "strandedness" in the context of the monomers of the heterodimeric proteins of the invention herein is meant that, similar to the two strands of DNA that "match", heterodimerization variants are incorporated into each monomer so as to preserve, create, and/or enhance the ability to "match" to form heterodimers. For example, if some pI variants are engineered into monomer A (e.g. making the pI higher), then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "wild type or WT" herein is meant an amino acid sequence or a nucleotide sequence that is found in nature, including allelic variations. A WT protein has an amino acid sequence or a nucleotide sequence that has not been intentionally modified.

The heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins from a cell culture such as host cell proteins. "Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

By "IL-12p40 subunit domain" herein is meant the β-chain (the p40 subunit; IL-12p40). As discussed herein, the IL-12p40 subunit domain can be a wild-type human sequence (e.g. SEQ ID NO: 3 from FIG. 1) or a variant thereof, as more fully discussed below (e.g. see FIGS. 20, 23 and 29, for example).

By "IL-12p35 subunit domain" herein is meant α-chain (the p35 subunit; IL-12p35). As discussed herein, the IL-12p35 subunit domain can be a wild-type human sequence (e.g. SEQ ID NO: 1 from FIG. 1) or a variant thereof, as more fully discussed below (e.g. see FIGS. 20, 23 and 29, for example).

The IL-12 subunit domains of the invention, when associated together, specifically bind to a dimeric IL-12 receptor complex comprising IL-12 receptor β1 and IL-12 receptor β2. The strength, or affinity, of specific binding can be expressed in terms of dissociation constant ($K_D$) of the interaction, wherein a smaller $K_D$ represents greater affinity and a larger $K_D$ represents lower affinity. Binding properties can be determined by methods well known in the art such as bio-layer interferometry and surface plasmon resonance based methods, including Biacore and Octet methodologies. One such method entails measuring the rates of antigen-binding site/antigen or receptor/ligand complex association and dissociation, wherein rates depend on the concentration of the complex partners, the affinity of the interaction, and geometric parameters that equally influence the rate in both directions. Thus, both the association rate ($k_a$) and the dissociation rate ($k_d$) can be determined, and the ratio of $k_d/k_a$ is equal to the dissociation constant $K_D$ (See Nature 361:186-187 (1993) and Davies et al. (1990) Annual Rev Biochem 59:439-473), both of which are incorporated by reference in their entirety for the methods therein.

Specific binding for a particular molecule can be exhibited, for example, by a molecule having a $K_D$ for a ligand (generally a receptor, in this case) of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater. Typically, a molecule that specifically binds its receptor will have a $K_D$ that is 20-, 50-, 100-, 500-, 1000-, 5,000-, 10,000- or more times greater for a control molecule relative to the receptor.

Also, specific binding for a particular molecule can be exhibited, for example, by a molecule having a $k_a$ or association rate for a ligand or receptor of at least 20-, 50-, 100-, 500-, 1000-, 5,000-, 10,000- or more times greater for the receptor relative to a control.

By "fused" or "covalently linked" is herein meant that the components (e.g., an IL-12 subunit and an Fc domain) are linked by peptide bonds, either directly or indirectly via domain linkers, outlined herein.

Figure 8B:
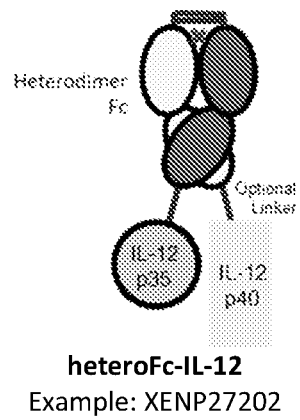
Figure 8C:
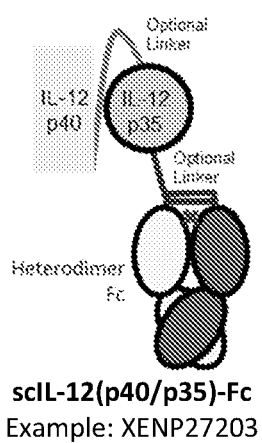
Figure 8D:
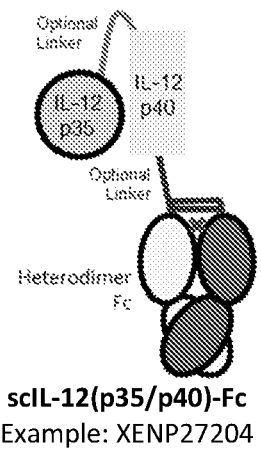

As used herein, the term "single-chain" refers to a molecule comprising amino acid domains linearly linked by peptide bonds. In certain embodiments, the biologically functional IL-12 is a single chain IL-12 complex or "scIL-12", i.e. the IL-12p35 subunit and the IL-12p40 subunit are fused to form a single peptide chain. In a particular such embodiment, the C-terminus of the IL-12p35 subunit is connected to the N-terminus of the IL-12p40 subunit, designated "scIL-12(p35/p40)". In another particular such embodiment, the C-terminus of the IL-12p40 subunit is connected to the N-terminus of the IL-12p35 subunit, designated "scIL-12(p40/p35)". Additionally, when these complexes are further fused to an Fc domain, they are still a "single chain". It should be noted that these single chain constructs, where the p35 and p40 subunits are on the same amino acid chain, still are part of a heterodimeric complex containing two amino acid chains (e.g. as shown in FIGS. 8C and 8D, the scIL-12(p35/p40) component and the "empty arm" Fc component). That is, there are two single chains that make up the heterodimeric complex.

The fusion proteins of the invention can take on a variety of formats, including heterodimeric formats such as those depicted in FIG. 8, as well as homodimeric formats such as those depicted in FIG. 14 and FIG. 48.

III. Heterodimeric Fc Fusion Proteins

In some aspects, the present invention relates to heterodimeric Fc fusion proteins that include an Fc region, generally linked (optionally through a domain linker) to one or more different IL-12 protein domains. These heterodimeric fusion proteins can take on a large number of different formats, as are generally depicted in FIG. 8. In one aspect, the heterodimeric Fc fusion protein is an IL-12 heterodimeric Fc fusion protein that includes IL-12p40 and IL-12p35 subunits in different orientations, such that they present together to bind to the IL-12 receptor complex of IL-12Rβ1/β2. The Fc domains can be derived from IgG Fc domains, e.g., IgGC, IgG2, IgG3 or IgG4 Fc domains, with IgG1 and IgG4 Fc domains finding particular use in the invention. As described herein, IgG1 Fc domains may be used, often, but not always in conjunction with ablation variants to ablate effector function. Similarly, when low effector function is desired, IgG4 Fc domains may be used.

As described herein and known in the art, the heterodimeric proteins of the invention comprise different domains, which can be overlapping as well. These domains include, but are not limited to, the Fc domain, the CH2 domain, the CH3 domain and the hinge domain, an IL-12p40 subunit domain and an I1-12p35 subunit domain. As described herein, these domains are linked together in different formats, as generally outlined in FIG. 8.

In some of the embodiments herein, when a protein fragment, e.g., IL-12p40 or IL-12p35 is attached to an Fc domain, it is the C-terminus of the protein fragment that is attached to all or part of the hinge of the Fc domain; for example, it is generally attached to the sequence EPKS (SEQ ID NO: 466) which is the beginning of the IgG1 hinge.

In other of the embodiments herein, when a protein fragment, e.g., IL-12p40 or IL-12p35 is attached to an Fc domain, it is the N-terminus of the protein fragment that is attached to the C-terminus of the CH3 domain.

In some of the constructs and sequences outlined herein of an Fc domain protein, the C-terminus of the IL-12p40 or IL-12p35 protein fragment is attached to the N-terminus of a domain linker, the C-terminus of which is attached to the N-terminus of a constant Fc domain (N-IL-12p40 or IL-12p35 protein fragment-linker-Fc domain-C) although that can be switched (N-Fc domain-linker-IL-12p40 or IL-12p35 protein fragment-C). In other constructs and sequences outlined herein, the C-terminus of a first protein fragment is attached to the N-terminus of a second protein fragment, optionally via a domain linker, the C-terminus of the second protein fragment is attached to the N-terminus of a constant Fc domain, optionally via a domain linker. In yet another construct, the N-terminus of a first protein fragment is attached to the C-terminus of a second protein fragment, optionally via a domain linker, the N-terminus of the second protein fragment is attached to the C-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

Accordingly, in some embodiments the present invention provides heterodimeric Fc fusion proteins that rely on the use of two different heavy chain variant Fc sequences, that will self-assemble to form a heterodimeric Fc domain fusion polypeptide. In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIGS. 8A-F are heterodimeric Fc fusion proteins, meaning that the protein has two associated Fc sequences self-assembled into a heterodimeric Fc domain and at least one protein fragment (e.g., 1, 2 or more protein fragments). In some cases, a first protein fragment is linked to a first Fc sequence and a second protein fragment is linked to a second Fc sequence. In some cases, the heterodimeric Fc fusion protein contains a first protein fragment linked to a second protein fragment which is linked to a first Fc sequence, and a second Fc sequence that is not linked to either the first or second protein fragments.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers. There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes described herein as "skew" variants (see discussion in WO2014/145806)), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric proteins and antibodies; one relies on the use of pI variants, such that each monomer, and subsequently each dimeric species, has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers and each dimeric species.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glutamine to glutamic acid), changing a charged residue from positive or negative to the opposite charge (e.g. aspartic acid to lysine) or changing a charged residue to a neutral residue (e.g., loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A:B+ or wt A:B−), or by increasing one region and decreasing the other region (A+:B− or A−:B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. The separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

A. Heterodimerization Variants

The present invention provides heterodimeric proteins, including heterodimeric Fc fusion proteins in a variety of formats, which utilize heterodimeric variants to allow for heterodimer formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in the FIG. 29 of U.S. Ser. No. 15/141,350, all of which is hereby incorporated by reference in its entirety, as well as in FIG. 2.

One mechanism is generally referred to in the art as "knobs and holes", referring to amino acid engineering that creates steric influences to favor heterodimeric formation and disfavor homodimeric formation, as described in U.S. Ser. No. 61/5%96,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer" corresponding sets) and C220E/P228E/368E paired with C220R/E224R/P228R/K409R.

Additional monomer A and monomer B variants can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 2. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S364K/E357L; K370S:S364K/E357Q; and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be used: one monomer may be wild type, or a variant that does not display a significantly different pI from wild-type, and the other can be either more basic or more acidic. Alternatively, each monomer may be changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgGC, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgGC) if one of the Fc monomers includes a CH1 domain. In some instances, the second monomer comprising a positively charged domain linker, including (GKPGS)$_4$ (SEQ ID NO: 462). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgGC).

In some embodiments, mutations are made in the hinge of the Fc domain, including positions 216, 217, 218, 219, 220, 221, 222, 223, 224, 225, 226, 227, 228, 229, and 230. Thus, pI mutations and particularly substitutions can be made in one or more of positions 216-230, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339. It should be noted that changes in 233-236 can be made to increase effector function (along with 327A) in the IgG2 backbone. Again, all possible combinations of these 14 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

D. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

E. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

F. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall' Acqua et al. showed that Fc mutants with increased FcRn binding at pH 6 and pH 7.4 actually had reduced serum concentrations and the same half-life as wild-type Fc (Dall' Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

There are a number of Fc substitutions that find use in increased binding to the FcRn and increased serum half-life, as specifically disclosed in U.S. Ser. No. 12/341,769, hereby incorporated by reference in its entirety, including, but not limited to, 434A, 428L, 308F, 259I, 428L/434S, 259I/308F, 436I/428L, 436I, 434S, 252Y/428L, 252Y/434S, 428/434S, 436V/428L and 259I/308F/428L.

G. Additional Fc Variants for Additional Functionality

In addition to pI amino acid variants, there are a number of useful Fc amino acid modification that can be made for a variety of reasons, including, but not limited to, altering binding to one or more FcγR, altered binding to FcRn, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

H. FcγR Variants

Accordingly, there are a number of useful Fc substitutions that can be made to alter binding to one or more of the Fcγ receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

I. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of immunomodulatory proteins, it is desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

J. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, may also be independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411T/E360E/Q362E:D401K; L368D/K370S: S364K/E357L; K370S:S364K/E357Q; T366S/L368A/Y407V:T366W; and T366S/L368A/Y407V:T366W (optionally including a bridging disulfide, T366S/L368A/Y407V/Y349C:T366W/S354C), optionally ablation variants, optionally charged domain linkers; and optionally pI variants.

In some embodiments, the Fc domain comprises one or more amino acid substitutions selected from the group consisting of: 236R, S239D, S239E, F243L, M252Y, V259I, S267D, S267E, S67K, S298A, V308F, L328F, L328R, 330L, I332D, I332E, M428L, N434A, N434S, 236R/L328R, S239D/I332E, 236R/L328F, V259I/V308F, S267E/L328F, M428L1N43S, Y436I/M428L, N436V/M428L, V436I/N434S, Y436I/N434S, S239D/I332E/330L, M252Y/S54T/T256E, V259I/V308F/M428L, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K according to EU index.

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprising Q295E/N384D/Q418E/N481D and the other a positively charged domain linker. As will be appreciated in the art, the "knobs in holes" variants do not change pI, and thus can be used on either monomer.

IV. Homodimeric Fc Fusion Proteins

In some aspects, the present invention relates to homodimeric Fc fusion proteins that include an Fc region, generally linked (optionally through a domain linker) to one or more different protein domains. These formats are generally shown in FIG. 14 and FIG. 48. In one aspect, the homodimeric Fc fusion protein is an IL-12 homodimeric Fc fusion protein that includes IL-12p40 and IL-12p35 subunits in different orientations, such that they present together to bind to the IL-12 receptor complex of IL-12Rβ1/β2. The Fc domains can be derived from IgG Fc domains, e.g., IgGC, IgG2, IgG3 or IgG4 Fc domains, with IgG1 and IgG4 Fc domains finding particular use in the invention. As described herein, IgG1 Fc domains may be used, often, but not always in conjunction with ablation variants to ablate effector function. Similarly, when low effector function is desired, IgG4 Fc domains may be used.

In one aspect, a homodimeric Fc fusion protein comprises first monomer and a second monomer comprising, from N- to C-terminal, IL-12p40 subunit-optional linker-IL-12p35 subunit-optional linker-Fc domain. In some embodiments, a homodimeric Fc fusion protein comprises a first monomer and a second monomer comprising, from N- to C-terminal, IL-12p40 subunit-linker-IL-12p35 subunit-linker-Fc domain. An example of an embodiment is provided in FIG. 48A.

In another aspect, a homodimeric Fc fusion protein comprises a first monomer and a second monomer comprising, from N- to C-terminal, IL-12p35 subunit-optional linker-IL-12p40 subunit-optional linker-Fc domain. In some embodiments, a homodimeric Fc fusion protein comprises a first monomer and a second monomer comprising, from N- to C-terminal, IL-12p35 subunit-linker-IL-12p40 subunit-linker-Fc domain. An example of an embodiment is provided in FIG. 48B.

In another aspect, a homodimeric Fc fusion protein comprises a first monomer and a second monomer comprising, from N- to C-terminal, Fc domain-optional linker-IL-12p40 subunit-optional linker-IL-12p35 subunit. In some embodiments, a homodimeric Fc fusion protein comprising a first monomer and a second monomer comprises, from N- to C-terminal, Fc domain-linker-IL-12p40 subunit-linker-IL-12p35 subunit. An example of an embodiment is provided in FIG. 48C.

In another aspect, a homodimeric Fc fusion protein comprises a first monomer and a second monomer comprising, from N- to C-terminal, Fc domain-optional linker-IL-12p35 subunit-optional linker-IL-12p40 subunit. In some embodiments, a homodimeric Fc fusion protein comprising a first monomer and a second monomer comprises, from N- to C-terminal, Fc domain-linker-IL-12p35 subunit-linker-IL-12p40 subunit. An example of an embodiment is provided in FIG. 48D.

In some embodiments, the bivalent IL-12p40-Fc format provides a homodimeric Fc fusion protein comprising: a) a first monomer comprising, from N- to C-terminal: i) a IL-12p40 domain protein; ii) an optional first domain linker; iii) a first variant Fc domain protein; and b) a second monomer comprising, from N- to C-terminal: i) a IL-12p40 domain protein; ii) optionally a second domain linker; iii) a second variant Fc domain protein.

In some embodiments, the bivalent IL-12p35-Fc format provides a homodimeric Fc fusion protein comprising: a) a first monomer comprising, from N- to C-terminal: i) a IL-12p35 domain protein; ii) an optional first domain linker; iii) a first variant Fc domain protein; and b) a second monomer comprising, from N- to C-terminal: i) a IL-12p35 domain protein; ii) optionally a second domain linker; iii) a second variant Fc domain protein.

In some embodiments, the (scIL-12(p40/p35))$_2$-Fc format provides a homodimeric Fc fusion protein comprising: a) a first monomer comprising, from N- to C-terminal: i) a IL-12p40 domain protein; ii) an optional first domain linker; iii) a IL-12p35 domain protein; iv) a optional second domain linker; v) a first variant Fc domain protein; and b) a second monomer comprising, from N- to C-terminal: i) a IL-12p40 domain protein; ii) optionally a third domain linker; iii) a IL-12p35 domain protein; iv) optionally a fourth domain linker; v) a second variant Fc domain protein.

In some embodiments, the (scIL-12(p35/p40))$_2$-Fc format provides a homodimeric Fc fusion protein comprising: a) a first monomer comprising, from N- to C-terminal: i) a IL-12p35 domain protein; ii) an optional first domain linker; iii) a IL-12p40 domain protein; iv) a optional second domain linker; v) a first variant Fc domain protein; and b) a second monomer comprising, from N- to C-terminal: i) a IL-12p35 domain protein; ii) optionally a third domain linker; iii) a IL-12p40 domain protein; iv) optionally a fourth domain linker; v) a second variant Fc domain protein.

In some embodiments, the Fc-(scIL-12(p40/p35))$_2$ format provides a homodimeric Fc fusion protein comprising: a) a first monomer comprising, from N- to C-terminal: i) a first variant Fc domain protein; ii) an optional first domain linker; iii) a IL-12p40 domain protein; iv) an optional second domain linker; v) a IL-12p35 domain protein; and b) a second monomer comprising, from N- to C-terminal: i) a second variant Fc domain protein; ii) an optional first domain linker; iii) a IL-12p40 domain protein; iv) an optional second domain linker; v) a IL-12p35 domain protein.

In some embodiments, the Fc-(scIL-12(p35/p40))$_2$ format provides a homodimeric Fc fusion protein comprising: a) a first monomer comprising, from N- to C-terminal: i) a first variant Fc domain protein; ii) an optional first domain linker; iii) a IL-12p35 domain protein; iv) an optional second domain linker; v) a IL-12p40 domain protein; and b) a second monomer comprising, from N- to C-terminal: i) a second variant Fc domain protein; ii) an optional first domain linker; iii) a IL-12p35 domain protein; iv) an optional second domain linker; v) a IL-12p40 domain protein.

In some embodiments, the first domain linker and said second domain linker have the same amino acid sequence. In some embodiments, the first domain linker and second domain linker have different amino acid sequences.

In some embodiments, the Fc variants comprise one or more skew, pI, and ablation variants as provided herein. In one embodiment, Fc variants comprise particular skew, pI, and ablation variants. In some embodiments, modifications promoting homodimerization of the first and the second Fc domains are a set of amino acid substitutions selected from the group consisting of L368D/K370S; S364K; S364K/E357L; S364K/E357Q; T411E/K360E/Q362E; D401K; T366S/L368A/Y407V; T366W; T366S/L368A/Y407V/Y349C; and T366W/S354C, according to EU numbering. In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering. In some embodiments the first and second Fc domains further comprise amino acid substitutions M428L/N424S.

In this format, useful IL-12p40 protein domains include, but are not limited to, SEQ ID NO: 4 (human IL-12 subunit beta (IL-12p40) mature form sequence). In this format, useful IL-12p40 variants include, but are not limited to, E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. In this format, useful IL-12p40 variants include, but are not limited to, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/

N113Q/N200Q/N281Q/C252S/K264E, and E59K/K99E/N103Q/N113Q/N200Q/N281Q/C252S/K264E.

In this format, IL-12p35 protein domains include SEQ ID NO: 2 (human IL-12 subunit alpha (IL-12p35) mature form sequence). In this format, useful IL-12p35 variants, include, but are not limited to, N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In this format, useful IL-12p35 variants, include, but are not limited to, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful embodiments include, but are not limited to, those found in FIGS. 14A-14B and FIG. 15.

Potential embodiments of homodimeric Fc fusion proteins may use methods and compositions described in the section above entitled "Heterodimeric Fc Fusion Proteins," as appropriate with the goal of producing a homodimer rather than heterodimer. Potential embodiments of homodimeric Fc fusion proteins may use any combination of methods and compositions described herein.

V. Interleukin 12

The present invention relates to the biologically functional form of interleukin 12. IL-12 heterodimeric Fc proteins comprising a IL-12p40 variant and/or a IL-12p35 variants have reduced or decreased binding affinity to IL-12 receptors compared to a wild-type IL-12, including the p40/p35 heterodimer and the p40 homodimer. IL-12 heterodimeric Fc proteins of the present invention have reduced or decreased potency compared to wild-type IL-12. IL-12 heterodimeric Fc proteins have prolonged or increased serum half-life. IL-12 heterodimeric Fc proteins have a reduced or decreased potential for toxicity. IL-12 heterodimeric Fc proteins of the present invention have reduced or decreased potency in inducing STAT4 phosphorylation in immune cells such as, but not limited to, T cells and NK cells. IL-12p40 variants comprise amino acid modifications (e.g., substitutions, additions, and deletions) that remove potential N-glycosylation sites. IL-12p35 variants comprise amino acid modifications (e.g., substitutions, additions, and deletions) that remove potential N-glycosylation sites. In some embodiments, the IL-12 heterodimeric Fc proteins of the present invention has reduced/decreased glycosylation compared to wild-type IL-12. In some embodiments, the glycosylation status of the IL-12 heterodimeric Fc proteins of the present invention is different than a wild-type IL-12 protein. IL-12 heterodimeric Fc proteins of the present invention provide improved pharmacokinetics compared to wild-type IL-12. Also, such IL-12 heterodimeric Fc proteins are therapeutically effective and have an improved therapeutic index such as compared to wild-type IL-12. IL-12 heterodimeric Fc proteins of the present invention can promote/induce T cell activation. In some embodiments, administration of any one of the IL-12 heterodimeric Fc proteins to a patient induces T cell activation in the patient. In some instances, administration induces IFN-gamma secretion in the patient. In some cases, administration of the IL-12 heterodimeric Fc proteins induces expansion of lymphocytes in the patient. IL-12 heterodimeric Fc proteins are useful for treating cancer such as solid tumor cancers or liquid tumor cancers. In some embodiments, administration of any one of the IL-12 heterodimeric Fc proteins to a patient, and in some cases, in combination with a checkpoint blockage agent reduces tumor size.

As stated above, the biologically functional form of interleukin 12 or "IL-12" is a heterodimer, composed of the IL-12p35 subunit (IL-12 subunit alpha) and the IL-12p40 subunit (IL-12 subunit beta), hereon designated as an "IL-12 heterodimeric complex". This complex can be used in two different formats. As shown in FIGS. 8A-B, the IL-12p40 subunit and the IL-12p35 subunits are not covalently attached to each other, but rather are covalently attached respectively to a first and a second Fc domain which are assembled as a heterodimer. Alternatively, the IL-12p35 and IL-12p40 subunits can be covalently attached, optionally using a domain linker (as described herein), as generally shown in FIGS. 8C-F, hereon designated a single-chain IL-12 complex or "scIL-12". The order of the two subunits in the scIL-12 may be designated as follows: "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit.

In some embodiments, the human IL12p35 protein has the amino acid sequence set forth in NCBI Ref. Seq. No. NP_000873.2 or SEQ ID NO:1 (Human IL-12 subunit alpha (IL-12p35) precursor sequence as depicted in FIG. 1). In some cases, the coding sequence of human IL-12p35 is set forth in NCBI Ref. Seq. No. NM_000882.3. An exemplary IL-12p35 protein of the Fc fusion heterodimeric protein outlined herein can have the amino acid sequence of SEQ ID NO:2 (Human IL-12 subunit alpha (IL-12p35) mature form sequence as depicted in FIG. 1) or amino acids 23-219 of SEQ ID NO:1. In some embodiments, the IL-12p35 protein has at least 90%, e.g., 90%, 91%, 92%, 93%, 94%, 95%, 96%, 97%, 98%, 99%, or more sequence identity to SEQ ID NO:2. The IL-12p35 protein of the Fc fusion protein can have 1, 2, 3, 4, 5, 6, 7, 8 or 9 amino acid mutations.

In some embodiments, the human IL-12p40 protein has the amino acid sequence set forth in NCBI Ref. Seq. No. NP_002178.3 or SEQ ID NO:3 (Human IL-12 subunit beta (IL-12p40) precursor sequence as depicted in FIG. 1). In some cases, the coding sequence of human IL-12p40 is set forth in NCBI Ref. Seq. No. NM_002187.3. An exemplary IL-12p40 protein of the Fc fusion protein outlined herein can have the amino acid sequence of SEQ ID NO:4 (Human IL-12 subunit beta (IL-12p40) mature form sequence as depicted in FIG. 1) or amino acids 23-328 of SEQ ID NO:3. In some embodiments, the IL-12p40 protein has at least 90%, e.g., 90%, 91%, 92%, 93%, 94%, 95%, 96%, 97/o, 98%, 99%, or more sequence identity to SEQ ID NO:4. The IL-12p40 protein of the Fc fusion protein can have 1, 2, 3, 4, 5, 6, 7, 8, or 9 amino acid mutations.

The present invention also provides variant IL-12p40 subunits and variant IL-12p35 subunits. These variants find use as part of the biologically functional IL-12 complex as well as any of the IL-12-Fc fusions described herein.

A. Expression Variants

As a preliminary matter, the IL-12p40 and IL-12p35 subunits of the invention also include variants to remove potential N-glycosylation sites designed to reduce heterogeneity.

Such potential N-glycosylation sites on IL-12p40 at which amino acid modifications can be introduced include N103, N113, N200, and N281 (numbered according to the Human IL-12 subunit beta (IL-12p40 mature form sequence as depicted in FIG. 1). Illustrative modifications at one or more of these sites may be selected from the group consisting of: N103D, N103Q, N113D, N113Q, N200D, N200Q, N281D, and N281Q. IL-12p40 expression variants can include one or more modifications at these sites. Accordingly, in one embodiment, the IL-12p40 variant comprises N103D/N113D/N200D/N281D. In one embodiment, the IL-12p40 variant comprises N103D/N113D. In one embodiment, the IL-12p40 variant comprises N103D/N200D. In one embodiment, the IL-12p40 variant comprises N103D/N281D. In one embodiment, the IL-12p40 variant comprises N113D/N200D. In one embodiment, the IL-12p40 variant comprises N113D/N281D. In one embodiment, the IL-12p40 variant comprises N200D/N281D. In one embodiment, the IL-12p40 variant comprises N103D/N113D/N200D. In one embodiment, the IL-12p40 variant comprises N103D/N113D/N281D. In one embodiment, the IL-12p40 variant comprises N/103D/N200D/N281D. In one embodiment, the IL-12p40 variant comprises N113D/N200D/N281D. In one embodiment, the IL-12p40 variant comprises N103Q/N113Q. In one embodiment, the IL-12p40 variant comprises N103Q/N200Q. In one embodiment, the IL-12p40 variant comprises N103Q/N281Q. In one embodiment, the IL-12p40 variant comprises N113Q/N200Q. In one embodiment, the IL-12p40 variant comprises N113Q/N281Q. In one embodiment, the IL-12p40 variant comprises N103Q/N113Q/N200Q. In one embodiment, the IL-12p40 variant comprises N103Q/N113Q/N281Q. In one embodiment, the IL-12p40 variant comprises N103Q/N200Q/N281Q. In one embodiment, the IL-12p40 variant comprises N113Q/N200Q/N281Q. These modifications can be used alone or in combination with any other IL-12p40 variants, such as affinity variants.

Such potential N-glycosylation sites on IL-12p35 at which amino acid modifications can be introduced at one or more of the sites selected from the group consisting of: N71, N85, and N195 (numbered according to the Human IL-12 subunit alpha (IL-12p35) mature form sequence as depicted in FIG. 1). Illustrative modifications at these sites include N71D, N71Q, N85D, N85Q, N195D, and N195Q. IL-12p35 variants can include one or more modifications at these sites. Accordingly, in one embodiment, the IL-12p35 variant comprises N71D/N85D/N195D. These modifications can be used alone or in combination with any other IL-12p35 variants, such as affinity variants.

The IL-12p40 subunit has a free cysteine at position 252 (numbered according to the Human IL-12 subunit beta (IL-12p40) mature form sequence as depicted in FIG. 1) which may bond with other free cysteines leading at least to heterogeneity and at worse to immunogenicity. Accordingly, IL-12p40 variants were engineered to remove the free cysteine, for example, by introducing C252S modification (although other substitutions may also be used). Modification of C252 (e.g. C252S) can be used alone or in combination with any other IL-12p40 variants, such as affinity or expression variants. Illustrative IL-12p40 variants comprising a modification at C252 to remove the free cysteine are depicted in FIG. 65. Illustrative IL-12-Fc fusions proteins were generated with the additional variant IL-12p40 subunits, sequences for which are depicted in FIG. 66, and produced as generally described in Example 1B. These modifications can be used alone or in combination with any other IL-12p40 variants, such as affinity variants.

B. Affinity and Potency Variants

The invention provides IL-12p40 variants and IL-12p35 variants which form biologically functional IL-12 with altered, that is either reduced or increased, binding affinity for IL-12 receptors. In some cases, the variant IL-12p40 subunit has altered, that is either reduced or increased, binding affinity for IL-12 receptor subunit beta-1 (IL-12Rβ1), IL-12 receptor subunit beta-2 (IL-12Rβ2), and/or the IL-12 receptor complex. In some cases, the variant IL-12p35 has altered, that is either reduced or increased, binding affinity for IL-12 receptor subunit beta-1 (IL-12R81), IL-12 receptor subunit beta-2 (IL-12Rβ2), and/or the IL-12 receptor complex. The invention also provides IL-12p40 variants and IL-12p35 variants which form biologically functional IL-12 with altered, that is either reduced or increased, potency compared to wild-type IL-12p40 and IL-12p35.

Suitable sites on IL-12p40 at which amino acid modifications can be introduced are selected from the group consisting of: E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299 (numbered according to the Human IL-12 subunit beta (IL-12p40 mature form sequence as depicted in FIG. 1). Illustrative modifications at these sites can be selected from the group consisting of: D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. IL-12p40 affinity variants can include modifications at one or more of these sites. Accordingly, in one embodiment, the IL-12p40 variant comprises N103D/N113D/N200D/N281D. In another embodiment, the IL-12p40 variant comprises Q42E/E45Q. In another embodiment, the IL-12p40 variant comprises E45Q/Q56E. In another embodiment, the IL-12p40 variant comprises Q42E/E59Q. In another embodiment, the IL-12p40 variant comprises Q56E/E59Q. In another embodiment, the IL-12p40 variant comprises Q42E/E45Q/Q56E. In another embodiment, the IL-12p40 variant comprises E45Q/Q56E/E59Q. In another embodiment, the IL-12p40 variant comprises E32Q/E59Q. In another embodiment, the IL-12p40 variant comprises D34N/E59K. In another embodiment, the IL-12p40 variant comprises D34N/E59K/K99E. In another embodiment, the IL-12p40 variant comprises D34K/E59K/K99E. In another embodiment, the IL-12p40 variant comprises E32Q/D34N/E59K/K99E. In another embodiment, the IL-12p40 variant comprises E32K/D34N/E59K/K99E. In another embodiment, the IL-12p40 variant comprises D34N/E59Q. In another embodiment, the IL-12p40 variant comprises E59Q/E187Q. In another embodiment, the IL-12p40 variant comprises S43E/E59Q. In another embodiment, the IL-12p40 variant comprises S43K/E49Q. In another embodiment, the IL-12p40 variant comprises E59Q/K163E. In another embodiment, the IL-12p40 variant comprises E59Q/K99E. In another embodiment, the IL-12p40 variant comprises E59Q/K258E. In another embodiment, the IL-12p40 variant comprises E59Q/K260E. In another embodiment, the IL-12p40 variant comprises E59K/K99E. In another embodiment, the IL-12p40 variant comprises D18K/E59K/K99E. In another embodiment, the IL-12p40 variant comprises E59K/K99E/K264E. In another embodiment, the IL-12p40 variant comprises E59K/K99Y. In another embodiment, the IL-12p40 variant comprises E59Y/K99Y. In another embodiment, the IL-12p40 variant comprises E59Y/K99E. In another embodiment, the IL-12p40 variant comprises E45K/E59K/K99E. In another embodiment, the IL-12p40 variant comprises E59K/K99E/Q144E. In another embodiment, the IL-12p40 variant comprises E59K/K99E/Q144K. In another embodiment, the IL-12p40 variant comprises E59K/K99E/R159E. In another embodiment, the IL-12p40 variant comprises E59K/K99E/K264E. In another embodiment, the IL-12p40 variant comprises D18K/E59K/K99E/K264E. In another embodiment, the IL-12p40 variant comprises D18K/E59K/K99E/C252S. In another embodiment, the IL-12p40 variant comprises D18K/E59K/K99E/C252S/K264E. In another embodiment, the IL-12p40 variant comprises E59K/K99Y/C252S. In another embodiment, the IL-12p40 variant comprises E59K/K99E/C252S/K264E. In another embodiment, the IL-12p40 variant comprises E59K/K99E/C252S. In another embodiment, the IL-12p40 variant comprises N103D/N113D. In another embodiment, the IL-12p40 variant comprises N103D/N200D. In another embodiment, the IL-12p40 variant comprises N103D/N281D. In another embodiment, the IL-12p40 variant comprises N113D/N200D. In another embodiment, the IL-12p40 variant comprises N113D/N281D. In another embodiment, the IL-12p40 variant comprises N200D/N281D. In another embodiment, the IL-12p40 variant comprises N103D/N113D/N200D. In another embodiment, the IL-12p40 variant comprises N103D/N113D/N281D. In another embodiment, the IL-12p40 variant comprises N103D/N200D/N281D. In another embodiment, the IL12p40 variant comprises N113D/N200D/N281D. In another embodiment, the IL-12p40 variant comprises N103Q/N113Q. In another embodiment, the IL-12p40 variant comprises N103Q/N200Q. In another embodiment, the IL-12p40 variant comprises N103Q/N281Q. In another embodiment, the IL-12p40 variant comprises N113Q/N200Q. In another embodiment, the IL-12p40 variant comprises N113Q/N281Q. In another embodiment, the IL-12p40 variant comprises N200Q/N281Q. In another embodiment, the IL-12p40 variant comprises N103Q/N113Q/N200Q. In another embodiment, the IL-12p40 variant comprises N103Q/N113Q/N281Q. In another embodiment, the IL-12p40 variant comprises N103Q/N200Q/N281Q. In another embodiment, the IL-12p40 variant comprises N113Q/N200Q/N281Q. In another embodiment, the IL-12p40 variant comprises N103Q/N113Q/N200Q/N281Q. In another embodiment, the IL-12p40 variant comprises E59K/K99E/N103Q/C252S/K264E. In another embodiment, the IL-12p40 variant comprises E59K/K99E/N113Q/C252S/K264E. In another embodiment, the IL-12p40 variant comprises E59K/K99E/N200Q/C252S/K264E. In another embodiment, the IL-12p40 variant comprises E59K/K99E/N281Q/C252S/K264E. In another embodiment, the IL-12p40 variant comprises E59K/K99E/N103Q/N113Q/C252S/K264E. In another embodiment, the IL-12p40 variant comprises E59K/K99E/N103Q/N200Q/C252S/K264E. In another embodiment, the IL-12p40 variant comprises E59K/K99E/N103Q/N281Q/C252S/K264E. In another embodiment, the IL-12p40 variant comprises E59K/K99E/N113Q/N200Q/C252S/K264E. In another embodiment, the IL-12p40 variant comprises E59K/K99E/N113Q/N281Q/C252S/K264E. In another embodiment, the IL-12p40 variant comprises E59K/K99E/N200Q/N281Q/C252S/K264E. In another embodiment, the IL-12p40 variant comprises E59K/K99E/N103Q/N113Q/N200Q/C252S/K264E. In another embodiment, the IL-12p40 variant comprises E59K/K99E/N103Q/N200Q/N281Q/C252S/K264E. In another embodiment, the IL-12p40 variant comprises E59K/K99E/N113Q/N200Q/N281Q/C252S/K264E. In another embodiment, the IL-12p40 variant comprises E59K/K99E/N103Q/N113Q/N200Q/N281Q/C252S/K264E.

Additionally, these modifications can be used alone or in combination with any other IL-12p40 variants, such as expression variants.

The IL-12p40 subunit has a free cysteine at position 252 (numbered according to the Human IL-12 subunit beta (IL-12p40) mature form sequence as depicted in FIG. 1) which may bond with other free cysteines leading at least to heterogeneity and at worse to immunogenicity. Accordingly, IL-12p40 variants were engineered to remove the free cysteine, for example, by introducing C252S modification (although other substitutions may also be used). Modification of C252 (e.g. C252S) can be used alone or in combination with any other IL-12p40 variants, such as affinity or expression variants. Illustrative IL-12p40 variants comprising a modification at C252 to remove the free cysteine are depicted in FIG. 65. Illustrative IL-12-Fc fusions proteins were generated with the additional variant IL-12p40 subunits, sequences for which are depicted in FIG. 66, and produced as generally described in Example 1B. Additionally, these modifications can be used alone or in combination with any other IL-12p40 variants, such as expression variants.

Suitable sites on IL-12p35 at which amino acid modifications can be introduced are selected from the group consisting of: Q20, N21, Q35, E38, S44, E45, E46, H49, K54, D55, T59, V60, E61, C63, L64, P65, E67, L68, N71, S73, C74, L75, N76, E79, N85, F96, M97, L89, L124, M125, Q130, Q135, N136, E143, Q146, N151, E153, K158, E162, E163, D165, I171, R181, I182, R183, V185, T186, D188, R189, V190, S192, Y193, and A196 (numbered according to the Human IL-12 subunit alpha (IL-12p35) mature form sequence as depicted in FIG. 1). Illustrative modifications are selected from the group consisting of: N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. IL-12p35 affinity variants can include modifications at one or more of these sites. Accordingly, in one embodiment, the IL-12p35 variant comprises N71D/N85D/N195D. In another embodiment, the IL-12p35 variant comprises N151D/E153Q. In another embodiment, the IL-12p35 variant comprises N151D/D165N. In another embodiment, the IL-12p35 variant comprises Q130E/N151D. In another embodiment, the IL-12p35 variant comprises N151D/K158E. In another embodiment, the IL-12p35 variant comprises E79Q/N151D. In another embodiment, the IL-12p35 variant comprises D55Q/N151D. In another embodiment, the IL-12p35 variant comprises N136D/N151D. In another embodiment, the IL-12p35 variant comprises N21D/N151D. In another embodiment, the IL-12p35 variant comprises E143Q/N151D. In another embodiment, the IL-12p35 variant comprises N71Q/N85Q. In another embodiment, the IL-12p35 variant comprises N71Q/N195Q. In another embodiment, the IL-12p35 variant comprises N85Q/N195Q. In another embodiment, the IL-12p35 variant comprises N71Q/N85Q/N195Q. In another embodiment, the IL-12p35 variant comprises N71D/N85D. In another embodiment, the IL-12p35 variant comprises N71D/N195D. In another embodiment, the IL-12p35 variant comprises N85D/N195D.

Additionally, these modifications can be used alone or in combination with any other IL-12p35 variants, such as expression variants.

A biologically functional IL-12 heterodimeric complex can comprise a wild-type IL-12p40 subunit and a wild-type IL-12p35 subunit, a variant IL-12p40 subunit and a wild-type IL-12p35 subunit, a wild-type IL-12p40 subunit and a variant IL-12p35 subunit, or a variant IL-12p40 subunit and a variant IL-12p35 subunit.

A biologically functional IL-12 bivalent homodimeric complex can comprise a wild-type IL-12p40 subunit and a wild-type IL-12p35 subunit, a variant IL-12p40 subunit and a wild-type IL-12p35 subunit, a wild-type IL-12p40 subunit and a variant IL-12p35 subunit, or a variant IL-12p40 subunit and a variant IL-12p35 subunit.

VI. Domain Linkers

In some embodiments, the IL-12p35 and IL-12p40 subunits are attached together via a linker. Optionally, the subunits are not attached via a linker. In other embodiments, the IL-12p35 and IL-12p40 subunits are noncovalently attached. In some embodiments, the IL-12p35 subunit is attached to an Fc domain via a linker. In certain embodiments, the IL-12p35 subunit is attached to an Fc domain directly, such as without a linker. In other embodiments, the IL-12p40 subunit is attached to an Fc domain via a linker. In other embodiments, the IL-12p40 subunit is attached to an Fc domain directly. In some cases, a linker is not used to attach the IL-12p35 subunit or IL-12p40 subunit to an Fc domain.

In some embodiments, the linker is a "domain linker", used to link any two domains as outlined herein together. While any suitable linker can be used, many embodiments utilize a glycine-serine polymer, including for example $(GS)_n$ (SEQ ID NO: 463), $(GSGGS)_n$ (SEQ ID NO: 464), $(GGGGS)_n$ (SEQ ID NO: 465), and $(GGGS)_n$ (SEQ ID NO: 432), where n is an integer of at least 0 (and generally from 0 to 1 to 2 to 3 to 4 to 5), as well as any peptide sequence that allows for recombinant attachment of the two domains with sufficient length and flexibility to allow each domain to retain its biological function. In certain cases, useful linkers include $(GGGGS)_0$ ("GGGGS" disclosed as SEQ ID NO: 9) or $(GGGGS)_1$ (SEQ ID NO: 9) or $(GGGGS)_2$ (SEQ ID NO: 10). Illustrative domain linkers are depicted in FIG. 6. In some cases, and with attention being paid to "strandedness", as outlined below, charged domain linkers can be used as discussed herein.

In addition, it has been previously reported that the serine in Gly-Ser linkers in Fc fusions may be subject to O-glycosylation. Accordingly, a final approach to decrease heterogeneity (in the context of Fc fusions) is to replace the Gly-Ser linkers used thus far with Gly-Ala linkers.

VII. Useful Formats of the Invention

As shown in FIGS. 8A-F there are a number of useful formats of the heterodimeric fusion proteins of the invention. In general, the heterodimeric fusion proteins of the invention have two functional components: an IL-12 heterodimer component and an Fc component, both of which can take different forms as outlined herein and both of which can be combined with the other component in any configuration.

In some embodiments, the IL-12p35 and IL-12p40 subunits are covalently linked, optionally with a domain linker, and is referred to herein as a single-chain IL-12 complex or "scIL-12". The scIL-12 can comprise either IL-12p35 N-terminally linked to IL-12p40 or IL-12p40 N-terminally linked to IL-12p35, optionally with a domain linker. The order of the two subunits in the scIL-12 may be designated as follows: "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p340 subunit.

In some embodiments, the IL-12p35 and IL-12p40 subunits are not covalently linked, but rather are covalently attached respectively to a first and a second Fc domain which are assembled as a heterodimer.

The first and the second Fc domains can have a set of amino acid substitutions selected from the group consisting of a) L368D/K370S and S364K; b) L368D/K370S and S364K/E357L; c) L368D/K370S and S364K/E357Q; d) S267K/L368D/K370S; e) T411E/K360E/Q362E and D401K; f) L368E/K370S and S364K; g) K370S and S364K/E357Q; and h) T366S/L368A/Y407V and T366W (optionally including a bridging disulfide, T366S/L368A/Y407V/Y349C and T366W/S354C), according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

Optionally, the first and/or second Fc domains have 428L/434S variants for half life extension.

A. IL-12-heteroFc Format

In one embodiment, the present invention provides the N-terminal IL-12 heterodimeric Fc fusion or "IL-12-heteroFc" format. In this embodiment, as shown in FIG. 8A, the heterodimeric fusion protein comprises two monomers. The first monomer comprises (from N- to C-terminus) IL-12p40-optional domain linker-Fc. The second monomer comprises (from N- to C-terminus) the IL-12p35-optional domain linker-Fc.

In the IL-12-heteroFc format, a preferred embodiment utilizes the skew variant pair S364K/E357Q:L368D/K370S.

In the IL-12-heteroFc format, a preferred embodiment is shown in FIG. 9 (XENP27201 including chain 1 chain 2).

In some embodiments, the IL-12-heteroFc format provides a heterodimeric Fc fusion protein comprising: a) a first monomer comprising, from N- to C-terminal: i) a IL-12p40 domain protein; ii) an optional first domain linker; iii) a first variant Fc domain protein; and b) a second monomer comprising, from N- to C-terminal: i) a IL-12p35 domain protein; ii) optionally a second domain linker; iii) a second variant Fc domain protein.

In some embodiments, the Fc variants comprise one or more skew, pI, and ablation variants as provided herein. In one embodiment, Fc variants comprise particular skew, pI, and ablation variants. In some embodiments, modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; T366S/L368A/Y407V/Y349C and T366W/S354C, according to EU numbering. In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering. In some embodiments the first and second Fc domains further comprise amino acid substitutions M428L/N424S.

In this format, useful IL-12p40 protein domains include, but are not limited to, SEQ ID NO: 4 (human IL-12 subunit beta (IL-12p40) mature form sequence). In this format, useful IL-12p40 variants include, but are not limited to, E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. In this format, useful IL-12p40 variants include, but are not limited to, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In this format, IL-12p35 protein domains include SEQ ID NO: 2 (human IL-12 subunit alpha (IL-12p35) mature form sequence). In this format, useful IL-12p35 variants, include, but are not limited to, N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In this format, useful IL-12p35 variants, include, but are not limited to, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85D, N71Q/N195Q, N85Q/N195Q, N71Q/N85Q/N195Q, N71D/N85D, N71D/N195D, and N85D/N195D.

In this format, useful combinations of a variant IL-12p40 subunit and IL-12p35 subunit include, but are not limited to IL-12p40(E59K/K99Y) and IL-12p35(SEQ ID NO: 2), IL-12p40(D18K/E59K/K99E) and IL-12p35 (SEQ ID NO: 2), IL-12p40(E59K/K99E/K264E) and IL-12p35(SEQ ID NO: 2), IL-12p40(D18K/E59K/K99E/K264E) and IL-12p35(SEQ ID NO: 2), IL-12p40(D18K/E59K/K99E/C252S) and IL-12p35(SEQ ID NO: 2), IL-12p40(D18K/E59K/K99E/C252S/K264E) and IL-12p35(SEQ ID NO: 2), IL-12p40(E59K/K99Y/C252S) and IL-12p35(SEQ ID NO: 2), IL-12p40(E59K/K99E/C252S/K264E) and IL-12p35 (SEQ ID NO: 2), and IL-12p40(E59K/K99E/C252S) and IL-12p35(SEQ ID NO: 2).

In this format, useful combinations of a variant IL-12p40 subunit and a IL-12p35 subunit include, but are not limited to a combination of an IL-12p35 comprising SEQ ID NO: 2 (human IL-12 subunit alpha (IL-12p35) mature form sequence) and a variant IL-12p40 comprising one or more substitutions including, but not limited, to E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, and E59K/K99E/N103Q/N113Q/N200Q/N281Q/C252S/K264E.

In this format, useful combinations of IL-12p40 and IL-12p35 variants include, but are not limited to a combination of an IL12p40 comprising SEQ ID NO: 4 (human IL-12 subunit beta (IL-12p40) mature form sequence) and an IL-12p35 comprising N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of IL-12p40 variants and IL-12p35 variants include, but are not limited to, a combination of an IL-12p40 variant comprising one or more amino acid substitution selected from the group consisting of: E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E; and an IL-12p35 variant comprising one or more substitutions selected from the group consisting of: N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful embodiments include but are not limited to those in which a variant IL-12p40 subunit domain is attached to said first Fc domain using a first domain linker and/or said IL-12p35 subunit domain is attached to said second Fc domain using a second domain linker.

In this format, useful embodiments include but are not limited to XENP31251, XENP31254, XENP31258, XENP32186, XENP32187, XENP32188, XENP32189, XENP32190, and XENP32191. In further embodiments, XENP31251, XENP31254, XENP31258, XENP32186, XENP32187, XENP32188, XENP32189, XENP32190, and XENP32191 include further glycoengineering.

In this format, useful embodiments include, but are not limited to, those found in FIGS. 44A-44K, and FIGS. 66A-66Q.

B. heteroFc-IL-12 Format

In another embodiment, the present invention provides the C-terminal IL-12 heterodimeric Fc fusion or “heteroFc-IL-12” format. In this embodiment, as shown in FIG. 8B, the heterodimeric fusion protein comprises two monomers. The first monomer comprises (from N- to C-terminus) Fc-optional domain linker-IL-12p40. The second monomer comprises (from N- to C-terminus) Fc-optional domain linker-IL-12p35.

In the heteroFc-IL-12 format, a preferred embodiment utilizes the skew variant pair S364K/E357Q:L368D/K370S.

In the IL-12-heteroFc format, a preferred embodiment is shown in FIG. 10 (XENP27202 including chain 1 chain 2).

In some embodiments, the heteroFc-IL-12 format provides a heterodimeric Fc fusion protein comprising: a) a first monomer comprising, from N- to C-terminal: i) a first variant Fc domain protein; ii) an optional first domain linker; iii) a IL-12p40 domain protein; and b) a second monomer comprising, from N- to C-terminal: i) a second variant Fc domain protein; ii) optionally a second domain linker; iii) a IL-12p35 domain protein.

In some embodiments, the Fc variants comprise one or more skew, pI, and ablation variants as provided herein. In one embodiment, Fc variants comprise particular skew, pI, and ablation variants. In some embodiments, modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; T366S/L368A/Y407V/Y349C and T366W/S354C, according to EU numbering. In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering. In some embodiments the first and second Fc domains further comprise amino acid substitutions M428L/N424S.

In this format, useful IL-12p40 protein domains include, but are not limited to, SEQ ID NO: 4 (human IL-12 subunit beta (IL-12p40) mature form sequence). In this format, useful IL-12p40 variants include, but are not limited to, E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. In this format, useful IL-12p40 variants include, but are not limited to, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In this format, IL-12p35 protein domains include SEQ ID NO: 2 (human IL-12 subunit alpha (IL-12p35) mature form sequence). In this format, useful IL-12p35 variants, include, but are not limited to, N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In this format, useful IL-12p35 variants, include, but are not limited to, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of a variant IL-12p40 subunit and IL-12p35 subunit include, but are not limited to IL-12p40(E59K/K99Y) and IL-12p35(SEQ ID NO: 2), IL-12p40(D18K/E59K/K99E) and IL-12p35 (SEQ ID NO: 2), IL-12p40(E59K/K99E/K264E) and IL-12p35(SEQ ID NO: 2), IL-12p40(D18K/E59K/K99E/K264E) and IL-12p35(SEQ ID NO: 2), IL-12p40(D18K/E59K/K99E/C252S) and IL-12p35(SEQ ID NO: 2), IL-12p40(D18K/E59K/K99E/C252S/K264E) and IL-12p35(SEQ ID NO: 2), IL-12p40(E59K/K99Y/C252S) and IL-12p35(SEQ ID NO: 2), IL-12p40(E59K/K99E/C252S/K264E) and IL-12p35 (SEQ ID NO: 2), and IL-12p40(E59K/K99E/C252S) and IL-12p35(SEQ ID NO: 2).

In this format, useful combinations of a variant IL-12p40 subunit and a IL-12p35 subunit include, but are not limited to a combination of an IL-12p35 comprising SEQ ID NO: 2 (human IL-12 subunit alpha (IL-12p35) mature form sequence) and a variant IL-12p40 comprising one or more substitutions including, but not limited, to E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K1E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103/N200Q, N103Q/N281Q, N113/N200Q, N113Q/N281Q, N200Q/N281Q, N103Q/N113/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N113Q/N113Q/N200Q/N281Q/C252S/K264E.

In this format, useful combinations of IL-12p40 and IL-12p35 variants include, but are not limited to a combination of an IL-12p40 comprising SEQ ID NO: 4 (human IL-12 subunit beta (IL-12p40) mature form sequence) and an IL-12p35 comprising N21D, Q35D, E38Q, D55Q, D55K, N71D, N71Q, L75A, N76D, E79Q, N85D, N85Q, L89A, F %6A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21 D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of IL-12p40 variants and IL-12p35 variants include, but are not limited to, a combination of an IL-12p40 variant comprising one or more amino acid substitution selected from the group consisting of: E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/

K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N200Q/N281Q/C252S/K264E; and an IL-12p35 variant comprising one or more substitutions selected from the group consisting of: N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful embodiments include, but are not limited to, those found in FIG. 10.

C. scIL-12-Fc Format

In a further embodiment, the present invention provides the N-terminal single-chain IL-12-Fc fusion or "scIL-12-Fc" format. In this embodiment, as shown in FIGS. 8C-D, the heterodimeric fusion protein comprises two monomers. The first monomer comprises (from N-to-C-terminus) scIL-12-optional domain linker-Fc. The second monomer comprises an "empty" Fc, comprising all or part of the hinge-CH2-CH3. The scIL-12 may be "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit.

In the scIL-12-Fc format, a preferred embodiment utilizes the skew variant pair S364K/E357Q:L368D/K370S.

In the scIL-12-Fc format, preferred embodiments are shown in FIG. 11 as XENP24203 (including chain 1 and chain 2) and XENP24204 (including chain 1 and chain 2).

In the scIL-12-Fc format, a preferred embodiment is shown in FIG. 50 as XENP31290 (including chain 1 and chain 2).

In some embodiments, the scIL-12-Fc format is a bivalent IL-12-Fc fusion. In some embodiments, the bivalent IL-12-Fc fusion format (FIGS. 48A-B) comprises two identical monomers each comprising a scIL-12 complex recombinant fused to the N-terminus of a homodimeric Fc chain (optionally via a domain linker).

In some embodiments, the scIL-12-Fc format a heterodimeric Fc fusion protein comprising: a) a first monomer comprising, from N- to C-terminal: i) a IL-12p40 domain protein; ii) an optional first domain linker; iii) a IL-12p35 domain protein; iv) an optional second linker; v) a first variant Fc domain protein; and b) a second monomer comprising a second variant Fc domain protein.

In some embodiments, the scIL-12-Fc format a heterodimeric Fc fusion protein comprising: a) a first monomer comprising, from N- to C-terminal: i) a IL-12p35 domain protein; ii) an optional first domain linker; iii) a IL-12p40 domain protein; iv) an optional second linker; v) a first variant Fc domain protein; and b) a second monomer comprising a second variant Fc domain protein.

In some embodiments, the Fc variants comprise one or more skew, pI, and ablation variants as provided herein. In one embodiment, Fc variants comprise particular skew, pI, and ablation variants. In some embodiments, modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; T366S/L368A/Y407V/Y349C and T366W/S354C, according to EU numbering. In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering. In some embodiments the first and second Fc domains further comprise amino acid substitutions M428L/N424S.

In this format, useful IL-12p40 protein domains include, but are not limited to, SEQ ID NO: 4 (human IL-12 subunit beta (IL-12p40) mature form sequence). In this format, useful IL-12p40 variants include, but are not limited to, E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. In this format, useful IL-12p40 variants include, but are not limited to, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In this format, IL-12p35 protein domains include SEQ ID NO: 2 (human IL-12 subunit alpha (IL-12p35) mature form sequence). In this format, useful IL-12p35 variants, include, but are not limited to, N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In this format, useful IL-12p35 variants, include, but are not limited to, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of a variant IL-12p40 subunit and IL-12p35 subunit include, but are not limited to IL-12p40(E59K/K99Y) and IL-12p35(SEQ ID NO: 2), IL-12p40(D18K/E59K/K99E) and IL-12p35 (SEQ ID NO: 2), IL-12p40(E59K/K99E/K264E) and IL-12p35(SEQ ID NO: 2), IL-12p40(D18K/E59K/K99E/K264E) and IL-12p35(SEQ ID NO: 2), IL-12p40(D18K/E59K/K99E/C252S) and IL-12p35(SEQ ID NO: 2), IL-12p40(D18K/E59K/K99E/C252S/K264E) and IL-12p35(SEQ ID NO: 2), IL-12p40(E59K/K99Y/C252S) and IL-12p35(SEQ ID NO: 2), IL-12p40(E59K/K99E/C252S/K264E) and IL-12p35 (SEQ ID NO: 2), and IL-12p40(E59K/K99E/C252S) and IL-12p35(SEQ ID NO: 2).

In this format, useful combinations of a variant IL-12p40 subunit and a IL-12p35 subunit include, but are not limited to a combination of an IL-12p35 comprising SEQ ID NO: 2 (human IL-12 subunit alpha (IL-12p35) mature form sequence) and a variant IL-12p40 comprising one or more substitutions including, but not limited, to E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N113Q/N113Q/N200Q/N281Q/C252S/K264E.

In this format, useful combinations of IL-12p40 and IL-12p35 variants include, but are not limited to a combination of an IL-12p40 comprising SEQ ID NO: 4 (human IL-12 subunit beta (IL-12p40) mature form sequence) and an IL-12p35 comprising N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21 D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of IL-12p40 variants and IL-12p35 variants include, but are not limited to, a combination of an IL-12p40 variant comprising one or more amino acid substitution selected from the group consisting of: E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/

K99E/N113Q/N281Q/C252S/K264E, E59K/K99E/N200Q/
N281Q/C252S/K264E, E59K/K99E/N103Q/N113Q/
N200Q/C252S/K264E, E59K/K99E/N103Q/N200Q/
N281Q/C252S/K264E, E59K/K99E/N113Q/N200Q/
N281Q/C252S/K264E, and E59K/K99E/N103Q/N113Q/
N200Q/N281Q/C252S/K264E; and an IL-12p35 variant
comprising one or more substitutions selected from the
group consisting of: N21D, Q35D, E38Q, D55Q, D55K,
N71D, N71Q, L75A, N76D, E79Q, N85D, N85Q, L89A,
F96A, M97A, L124A, M125A, Q130E, Q135E, N136D,
E143Q, Q146E, N151D, N151K, E153K, E153Q, K158E,
E162Q, E163Q, D165N, I171A, N195D, N195Q, N71D/
N85D/N195D, N151D/E153Q, N151D/D165N, Q130E/
N151D, N151D/K158E, E79Q/N151D, D55Q/N151D,
N136D/N151D, N21D/N151D, E143Q/N151D, N71Q/
N85Q, N71Q/N195Q, N85Q/N195Q, N71Q/N85Q/N195Q,
N71D/N85D, N71D/N195D, and N85D/N195D.

In this format, useful embodiments include, but are not limited to, those found in FIG. 11.

D. Fc-scIL-12 Format

Figure 8E:
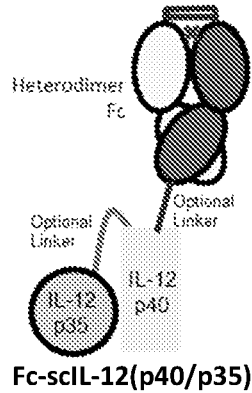
Figure 8F:
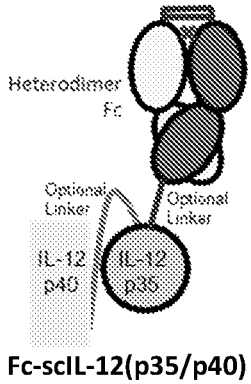

In an additional embodiment, the present invention provides the C-terminal single-chain IL-12-Fc fusion or "Fc-scIL-12" format. In this embodiment, as shown in FIGS. 8E-F, the heterodimeric fusion protein comprises two monomers. The first monomer comprises (from N-to-C-terminus) Fc-optional linker-scIL-12. The second monomer comprises an "empty" Fc, comprising all or part of the hinge-CH2-CH3. As above, the scIL-12 may be "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit.

In the Fc-scIL-12 format, a preferred embodiment utilizes the skew variant pair S364K/E357Q:L368D/K370S.

In some embodiments, the scIL-12-Fc format is a bivalent IL-12-Fc fusion. In some embodiments, the bivalent IL-12-Fc fusion format (FIGS. 48C-D) comprises two identical monomers each comprising a scIL-12 complex recombinant fused to the C-terminus of a homodimeric Fc chain (optionally via a domain linker).

In some embodiments, the scIL-12-Fc format provides a heterodimeric Fc fusion protein comprising: a) a first monomer comprising, from N- to C-terminal: i) a first variant Fc domain protein; ii) an optional first domain linker; iii) a IL-12p40 domain protein; iv) an optional second domain linker; v) a IL-12p35 domain protein; and b) a second monomer comprising a second variant Fc domain protein.

In some embodiments, the scIL-12-Fc format provides a heterodimeric Fc fusion protein comprising: a) a first monomer comprising, from N- to C-terminal: i) a first variant Fc domain protein; ii) an optional first domain linker; iii) a IL-12p35 domain protein; iv) an optional second domain linker; v) a IL-12p40 domain protein; and b) a second monomer comprising a second variant Fc domain protein.

In some embodiments, the Fc variants comprise one or more skew, pI, and ablation variants as provided herein. In one embodiment, Fc variants comprise particular skew, pI, and ablation variants. In some embodiments, modifications promoting heterodimerization of the first and the second Fc domains are a set of amino acid substitutions selected from the group consisting of L368D/K370S and S364K; L368D/K370S and S364K/E357Q; L368D/K370S and S364K/E357Q; T411E/K360E/Q362E and D401K; L368E/K370S and S364K; K370S and S364K/E357Q; T366S/L368A/Y407V and T366W; T366S/L368A/Y407V/Y349C and T366W/S354C, according to EU numbering. In some embodiments, the first and/or the second Fc domains have an additional set of amino acid substitutions comprising Q295E/N384D/Q418E/N421D, according to EU numbering. In some embodiments, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering. In some embodiments the first and second Fc domains further comprise amino acid substitutions M428L/N424S.

In this format, useful IL-12p40 protein domains include, but are not limited to, SEQ ID NO: 4 (human IL-12 subunit beta (IL-12p40) mature form sequence). In this format, useful IL-12p4) variants include, but are not limited to, E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. In this format, useful IL-12p40 variants include, but are not limited to, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K1E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N113Q/N113Q, N103Q/N200Q, N103Q/N281Q, N113Q/N200Q, N113Q/N281Q, N200Q/N281Q, N113Q/N113Q/N200Q, N103Q/N113Q/N281Q, N103Q/N200Q/N281Q, N113Q/N200Q/N281Q, N103Q/N113Q/N200Q/N281Q, N103Q/N113Q/N200Q/N281Q, N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N113Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/C252S/K264E, E59K/K99E/N103Q/N200Q/N281Q/C252S/K264E, E59K/K99E/N113Q/N200Q/N281Q/C252S/K264E, and E59K/K99E/N113Q/N113Q/N200Q/N281Q/C252S/K264E.

In this format, IL-12p35 protein domains include SEQ ID NO: 2 (human IL-12 subunit alpha (IL-12p35) mature form sequence). In this format, useful IL-12p35 variants, include, but are not limited to, N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In this format, useful IL-12p35 variants, include, but are not limited to, N71D/N85D/N195D, N151D/E153Q, N151D/D165N, Q130E/N151D, N151D/K158E, E79Q/N151D, D55Q/

N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of a variant IL-12p40 subunit and IL-12p35 subunit include, but are not limited to IL-12p40(E59K/K99Y) and IL-12p35(SEQ ID NO: 2), IL-12p40(D18K/E59K/K99E) and IL-12p35 (SEQ ID NO: 2), IL-12p40(E59K/K99E/K264E) and IL-12p35(SEQ ID NO: 2), IL-12p40(D18K/E59K/K99E/K264E) and IL-12p35(SEQ ID NO: 2), IL-12p40(D18K/E59K/K99E/C252S) and IL-12p35(SEQ ID NO: 2), IL-12p40(D18K/E59K/K99E/C252S/K264E) and IL-12p35(SEQ ID NO: 2), IL-12p40(E59K/K99Y/C252S) and IL-12p35(SEQ ID NO: 2), IL-12p40(E59K/K99E/C252S/K264E) and IL-12p35 (SEQ ID NO: 2), and IL-12p40(E59K/K99E/C252S) and IL-12p35(SEQ ID NO: 2).

In this format, useful combinations of a variant IL-12p40 subunit and a IL-12p35 subunit include, but are not limited to a combination of an IL-12p35 comprising SEQ ID NO: 2 (human IL-12 subunit alpha (IL-12p35) mature form sequence) and a variant IL-12p40 comprising one or more substitutions including, but not limited, to E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, E299Q, N103D/N13D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103D/N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/N281Q/C252S/K264E.

In this format, useful combinations of IL-12p40 and IL-12p35 variants include, but are not limited to a combination of an IL-12p40 comprising SEQ ID NO: 4 (human IL-12 subunit beta (IL-12p40) mature form sequence) and an IL-12p35 comprising N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.

In this format, useful combinations of IL-12p40 variants and IL-12p35 variants include, but are not limited to, a combination of an IL-12p40 variant comprising one or more amino acid substitution selected from the group consisting of: E59K, E59Q, D18N, D18K, E32Q, E33Q, D34N, D34K, Q42E, S43E, S43K, E45Q, Q56E, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q C252S, Q256N, K258E, K260E, E262Q, K264E, N281D, N281Q, E299Q, N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N1130/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, and E59K/K99E/N103Q/N113Q/N200Q/N281Q/C252S/K264E; and an IL-12p35 variant comprising one or more substitutions selected from the group consisting of: N21D, Q35D, E38Q, D55Q, D55K, N71D, N71Q, L75A, N76D, E79Q, N85D, N85Q, L89A, F%6A, M97A, L124A, M125A, Q130E, Q135E, N136D, E143Q, Q146E, N151D, N151K, E153K, E153Q, K158E, E162Q, E163Q, D165N, I171A, N195D, N195Q, N71D/N85D/N195D, N151D/E153Q, N151D/D165N, Q130E/N151D, N151D/K158E, E79Q/N151D, D55Q/N151D, N136D/N151D, N21 D/N151D, E143Q/N151D, N71Q/N85Q, N71Q/N195Q, N85Q/N195Q, N71Q/N85Q/N195Q, N71D/N85D, N71D/N195D, and N85D/N195D.

VIII. Useful Embodiments of the Invention

As will be appreciated by those in the art and discussed more fully below, the heterodimeric fusion proteins of the present invention can take on a wide variety of configurations, as are generally depicted in FIGS. 8A-F. The amino acid sequences of exemplary fusion proteins are provided in FIGS. 9-11.

Many of the embodiments outlined herein rely in general on the format comprising a first monomer (first fusion protein) comprising an IL-12p35 subunit domain covalently attached (optionally via a domain linker) to the N-terminus of a first Fc domain, and a second monomer (second fusion protein) comprising an IL-12p40 subunit domain covalently attached (optionally via a domain linker) to the N-terminus of a second Fc domain. Exemplary embodiments of this format include, but are not limited to XENP27201. In additional embodiments, the first monomer has a polypeptide sequence selected from the group consisting of i) SEQ ID NO:47 (XENP27201 Chain 1), ii) SEQ ID NO:85 (XenD24752), iii) SEQ ID NO:86 (XenD24753), iv) SEQ ID NO:87 (XenD24754), v) SEQ ID NO:88 (XenD24755), vi) SEQ ID NO:89 (XenD24756), vii) SEQ ID NO:90 (XenD24757), viii) SEQ ID NO:91 (XenD24758), ix) SEQ ID NO:92 (XenD24759), x) SEQ ID NO:93 (XenD24760), xi) SEQ ID NO:94 (XenD24761), xii) SEQ ID NO:95 (XenD24762), xiii) SEQ ID NO:96 (XenD24763), xiv) SEQ ID NO:97 (XenD24764), xv) SEQ ID NO:98 (XenD24765), xvi) SEQ ID NO:99 (XenD24766), xvii) SEQ ID NO:100 (XenD24767), xviii) SEQ ID NO:101 (XenD24768), xix) SEQ ID NO:102 (XenD24769), xx) SEQ ID NO:103 (XenD24770), xxi) SEQ ID NO:104 (XenD24771), xxii) SEQ ID NO:105 (XenD24772), xxiii) SEQ ID NO:106 (XenD24773), xxiv) SEQ ID NO:107 (XenD24774), xxv) SEQ ID NO:108 (XenD24775), xxvi) SEQ ID NO:109 (XenD24776), xxvii) SEQ ID NO:110 (XenD24777), xxviii) SEQ ID NO:111 (XenD24778), xxix) SEQ ID NO:112 (XenD24792), xxx) SEQ ID NO:215 (XenD25922), xxxi) SEQ ID NO:216 (XenD25923), xxxii) SEQ ID NO:217 (XenD25924), xxxiii) SEQ ID NO:218 (XenD25925), xxxiv) SEQ ID NO:219 (XenD25926), xxxv) SEQ ID NO:220 (XenD25927), xxxvi) SEQ ID NO:221 (XenD25928), xxxvii) SEQ ID NO:222 (XenD25929), xxxviii) SEQ ID NO:223 (XenD25930), and xxxix) SEQ ID NO:224 (XenD25931); and the second monomer has a polypeptide sequence selected from the group consisting of i) SEQ ID NO:48 (XENP27201 Chain 2), ii) SEQ ID NO:126 (XenD24779), iii) SEQ ID NO:127 (XenD24780), iv) SEQ ID NO:128 (XenD24781), v) SEQ ID NO:129 (XenD24782), vi) SEQ ID NO:130 (XenD24783), vii) SEQ ID NO:131 (XenD24784), viii) SEQ ID NO:132 (XenD24785), ix) SEQ ID NO:133 (XenD24786), x) SEQ ID NO:134 (XenD24787), xi) SEQ ID NO:135 (XenD24788), xii) SEQ ID NO:136 (XenD24789), xiii) SEQ ID NO:137 (XenD24790), xiv) SEQ ID NO:138 (XenD24791), xv) SEQ ID NO:236 (XenD25911), xvi) SEQ ID NO:237 (XenD25912), xvii) SEQ ID NO:238 (XenD25913), xviii) SEQ ID NO:239 (XenD25914), xix) SEQ ID NO:240 (XenD25915), xx) SEQ ID NO:241 (XenD25916), xxi) SEQ ID NO:242 (XenD25917), xxii) SEQ ID NO:243 (XenD25918), xxiii) SEQ ID NO:244 (XenD25919), xxiv) SEQ ID NO:245 (XenD25920), and xxv) SEQ ID NO:246 (XenD25921). Particular such embodiments include, but are not limited to, XENP27201, XENP28820, XENP28821, XENP28822, XENP28823, XENP28824, XENP28825, XENP28826, XENP28827, XENP28828, XENP28829, XENP28830, XENP28831, XENP28832, XENP28833, XENP28834, XENP28835, XENP28836, XENP28837, XENP28838, XENP28839, XENP28840, XENP28841, XENP28842, XENP28843, XENP28844, XENP28845, XENP28846, XENP28847, XENP28848, XENP28849, XENP28850, XENP28851, XENP28852, XENP29949, XENP29950, XENP29951, XENP29952, XENP30597, XENP30598, XENP30599, XENP30600, XENP30601, XENP30602, XENP30603, XENP30604, XENP30605, XENP30606. XENP30307, XENP30308, XENP30609, XENP31250, XENP31251, XENP31252, XENP31253, XENP31254, XENP31255, XENP31256, XENP31257, XENP31258, XENP31259, XENP31260, XENP31261, XENP31262, XENP31263, XENP31264, XENP31265, XENP31286, XENP31142, XENP31143, XENP31144, XENP31145, XENP31146, XENP31582, XENP31583, XENP31584, XENP32187, XENP32188, XENP32189, XENP32190, XENP32191, XENP32991, XENP32992, XENP32993, XENP32994, XENP32995, XENP32996, XENP32997, XENP32998, XENP32999, XENP33000, XENP33001, XENP33002, XENP33003, XENP33004, XENP33005, XENP33006, XENP33007, XENP33008, XENP33008, XENP33009, XENP33010, and XENP33011. A useful embodiment of a heterodimer Fc fusion protein comprises a first monomer (first fusion protein) comprising an IL-12p35 subunit domain covalently attached (optionally via a domain linker) to the C-terminus of a first Fc domain, and a second monomer (second fusion protein) comprising an IL-12p40 subunit domain covalently attached (optionally via a domain linker) to the C-terminus of a second Fc domain. Exemplary embodiments of this format include, but are not limited to XENP27202.

Another useful embodiment of a heterodimer Fc fusion protein comprises a first monomer (first fusion protein) comprising a single-chain IL-12 complex ("scIL-12") covalently attached (optionally via a domain linker) to the N-terminus of a first Fc domain, and a second Fc domain (e.g., an empty Fc domain). The scIL-12 may be "scIL-12 (p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit. Exemplary embodiments of this format includes, but is not limited to, XENP27203 and XENP27204.

A further useful embodiment of a heterodimer Fc fusion protein comprises a first monomer (first fusion protein) comprising a single-chain IL-12 complex ("scIL-12") covalently attached (optionally via a domain linker) to the C-terminus of a first Fc domain, and a second Fc domain (e.g., an empty Fc domain). The scIL-12 may be "scIL-12 (p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit.

For any of the heterodimer Fc fusion proteins outlined herein, the optional domain linkers used on the first monomer, on the second monomer, and/or in the scIL-12 can be the same or different. In addition, the first Fc domain and the second Fc domain of the heterodimeric protein can have different amino acid sequences.

The Fc domains of the present invention comprise IgG Fc domains, e.g., IgG1 Fc domains. In some embodiments, the first and second Fc domains comprising a set of amino acid substitutions selected from the group consisting of: L368D/K370S and S364K; L368D/K370S and S364K/E357L; L368D/K370S and S364K/E357Q; T411E/K360E/Q362E and D401K; L368E/K370S and S364K; K370S and S364K/E357Q and T366S/L368A/Y407V:T366W (optionally including a bridging disulfide, T366S/L368A/Y407V/Y349C:T366W/S354C), according to EU numbering. In some instances, the first and/or the second Fc domains of any of the heterodimeric Fc fusion formats outlined herein can have an additional set of amino acid substitutions comprising Q295E/N384D/Q418E/N421D, according to EU numbering. In some embodiments, the first and/or the second Fc domains have an additional set of amino acid substitutions selected from the group consisting of G236R/L328R, E233P/L234V/L235A/G236_/S239K, E233P/L234V/L235A/G236_/S239K/A327G, E233P/L234V/L235A/G236_/S267K/A327G, E233P/L234V/L235A/G236_, and E233P/L234V/L235A/G236_/S267K, according to EU numbering.

Additional heterodimerization or homodimerization variants can be independently and optionally included and selected from variants outlined in the figures. These compositions can further comprise ablation variants, pI variants, charged variants, isotypic variants, etc.

A. IL-12p40 Variants

In some embodiments, the IL-12p40 subunit is a variant IL-12p40 subunit. In some particular such embodiments, the IL-12p40 subunit is a variant IL-12p40 subunit having reduced heterogeneity. In other particular such embodiments, the IL-12p40 subunit is a variant IL-12p40 subunit having altered, that is either reduced or increased, affinity for IL-12 receptor subunit beta-1 (IL-12Rβ1), IL-12 receptor subunit beta-2 (IL-12Rβ2), and/or IL-12 receptor complex. In some embodiments, the variant IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299. (numbered according to the human IL-12 subunit beta (IL-12p40) mature form sequence).

In some embodiments, the variant IL-12p40 subunit has one or more amino acid substitutions selected from the group consisting of D18N, D18K, E32Q, E33Q, D34N, D34K, Q42E, S43E, S43K, E45Q, Q56E, E59Q, E59K, D62N, E73Q, D87N, K99E, K99Y, E100Q, N103D, N103Q, N113D, N113Q, Q144E, D161N, R159E, K163E, E187Q, N200D, N200Q, N218Q, Q229E, E235Q, C252S, Q256N, K258E, K260E, E262Q, K264E, N281D, N281Q, and E299Q. In some embodiments, the variant IL-12p40 subunit has amino acid substitutions selected from the group consisting of N103D/N113D/N200D/N281D, Q42E/E45Q, E45Q/Q56E, Q42E/E59Q, Q56E/E59Q, Q42E/E45Q/Q56E, E45Q/Q56E/E59Q, E32Q/E59Q, D34N/E59K, D34N/E59K/K99E, D34K/E59K/K99E, E32Q/D34N/E59K/K99E, E32K/D34N/E59K/K99E, D34N/E59Q, E59Q/E187Q, S43E/E59Q, S43K/E49Q, E59Q/K163E, E59Q/K99E, E59Q/K258E, E59Q/K260E, E59K/K99E, D18K/E59K/K99E, E59K/K99E/K264E, E59K/K99Y, E59Y/K99Y, E59Y/K99E, E45K/E59K/K99E, E59K/K99E/Q144E, E59K/K99E/Q144K, E59K/K99E/R159E, E59K/K99E/K264E, D18K/E59K/K99E/K264E, D18K/E59K/K99E/C252S, D18K/E59K/K99E/C252S/K264E, E59K/K99Y/C252S, E59K/K99E/C252S/K264E, E59K/K99E/C252S, N103D/N113D, N103D/N200D, N103D/N281D, N113D/N200D, N113D/N281D, N200D/N281D, N103D/N113D/N200D, N103D/N113D/N281D, N103D/N200D/N281D, N113D/N200D/N281D, N103Q/N113Q, N103Q/N200Q, N103Q/N281Q, N113Q/N200Q, N113Q/N281Q, N200Q/N281Q, N103Q/N113Q/N200Q, N103Q/N113Q/N281Q, N103Q/N200Q/N281Q, N113Q/N200Q/N281Q, N103Q/N113Q/N200Q/N281Q, E59K/K99E/N103Q/C252S/K264E, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, and E59K/K99E/N103Q/N113Q/N200Q/N281Q/C252S/K264E.

In some embodiments, the IL-12p40 variant has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E49Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)), l) SEQ ID NO: 325 (IL-12p40 (E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362

(IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200J/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

B. IL-12p35 Variants

In some embodiments, the IL-12p35 subunit is a variant IL-12p35 subunit. In some particular such embodiments, the IL-12p35 subunit is a variant IL-12p35 subunit having reduced heterogeneity. In other particular such embodiments, the IL-12p35 subunit is a variant IL-12p35 subunit having altered, that is either reduced or increased, affinity for IL-12 receptor subunit beta-1 (IL-12Rβ1), IL-12 receptor subunit beta-2 (IL-12Rβ2), and/or IL-12 receptor complex. In some embodiments, the variant IL-12p35 subunit has one or more amino acid modifications at amino acid residues selected from the group consisting of: Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196. (numbered according to the Human IL-12 subunit alpha (IL-12p35) mature form sequence). In some embodiments, the variant IL-12p35 subunit has one or more amino acid substitutions selected from the group consisting of: N21D, Q35D, E38Q, D55Q, D55K, N71D, N71Q, L75A, N76D, E79Q, N85D, N85Q, L9A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In some embodiments, the variant IL-12p35 subunit has amino acid substitutions N71D/N85D/N195D, N151D/E153Q, N151D/D165N, Q130E/N151D, N151D/K158E, E79Q/N151D, D55Q/N151D, N136D/N151D, N21D/N151D, E143Q/N151D, N71Q/N85Q, N71Q/N195Q, N85Q/N195Q, N71Q/N85Q/N195Q, N71D/N85D, N71D/N195D, and N85D/N195D.. In some embodiments, the variant IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35 (N21D), xv) SEQ ID NO:333 IL-12p35(D55Q), xvi) IL-12p35(E79Q), xvii) IL-12p35(Q130E), xviii) IL-12p35 (N136D), xix) IL-12p35(E143Q), xx) SEQ ID NO:227 (IL-12p35(N151K)), xxi) SEQ ID NO:226 (IL-12p35 (E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)),xxxiii) SEQ ID NO: 345 (IL-12p35(F96A)),xxxiv) SEQ ID NO: 346 (IL-12p35(M97A)), xxxv) SEQ ID NO: 347 (IL-12p35(L89A)),xxxvi) SEQ ID NO: 348 (IL-12p35 (L124A)),xxxvii) SEQ ID NO: 349 (IL-12p35(M125A)), xxxviii) SEQ ID NO: 350 (IL-12p35(L75A)), xxxiv) SEQ ID NO: 351 (IL-12p35(I171A)),xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)),xxxix) SEQ ID NO: 283 (IL-12p35 (N71Q/N195Q)),lx) SEQ ID NO: 284 (IL-12p35 (N85Q/N195Q),lxi) SEQ ID NO: 285 (IL-12p35 (N71Q/N85Q/N195Q)),lxii) SEQ ID NO: 286 (IL-12p35 (N71D/N85D)), lxiii) SEQ ID NO: 287 (IL-12p35 (N71D/N195D),lxiv) SEQ ID NO: 288 (IL-12p35 (N85D/N195D)), lxv) SEQ ID NO: 333 (IL-12p35 (D55Q)), and lxvi) SEQ ID NO: 334 (IL-12p35 (D55K)).

C. Additional Options

In some embodiments, the scIL-12-Fc format is a bivalent IL-12-Fc fusion. In some embodiments, the bivalent IL-12-Fc fusion format (FIGS. 48A-B) comprises two identical monomers each comprising a scIL-12 complex recombinant fused to the N-terminus of a homodimeric Fc chain (optionally via a domain linker). In some embodiments, the bivalent IL-12-Fc fusion format (FIGS. 48C-D) comprises two identical monomers each comprising a scIL-12 complex recombinant fused to the C-terminus of a homodimeric Fc chain (optionally via a domain linker). Examples include but are not limited to XENP31289 and XENP31291 (FIG. 49).

In some embodiments, the IL-12 Fc fusion proteins are further engineered for extending half-life by substitutions comprising M428L and N434S. In some embodiments, the IL-12 Fc fusion proteins are further engineered for extending half-life by substitutions comprising M428L/N434S. Any of the IL-12 Fc fusions listed in herein may be engineered for extending half-life. Examples include but are not limited to XENP31582, XENP31583, and XENP31584 (FIG. 65).

In some embodiments, examples of heterodimeric Fc fusion proteins include XENP27201, XENP28820, XENP28821, XENP28822, XENP28823, XENP28824, XENP28825, XENP28826, XENP28827, XENP28828, XENP28829, XENP28830, XENP28831, XENP28832, XENP28833, XENP28834, XENP28835, XENP28836, XENP28837, XENP28838, XENP28839, XENP28840, XENP28841, XENP28842, XENP28843, XENP28844, XENP28845, XENP28846, XENP28847, XENP28848, XENP28849, XENP28850, XENP28851, XENP28852, XENP29949, XENP29950, XENP29951, XENP29952, XENP30597, XENP30598, XENP30599, XENP30600, XENP30601, XENP30602, XENP30603, XENP30604, XENP30605, XENP30606. XENP30307, XENP30308, XENP30609, XENP31250, XENP31251, XENP31252, XENP31253, XENP31254, XENP31255, XENP31256, XENP31257, XENP31258, XENP31259, XENP31260, XENP31261, XENP31262, XENP31263, XENP31264, XENP31265, XENP31286, XENP31142, XENP31143, XENP31144, XENP31145, XENP31146, XENP31582, XENP31583, XENP31584, XENP32186, XENP32187, XENP32188, XENP32189, XENP32190, XENP32191, XENP32991, XENP32992, XENP32993, XENP32994, XENP32995, XENP32996, XENP32997, XENP32998, XENP32999, XENP33000, XENP33001, XENP33002, XENP33003, XENP33004, XENP33005, XENP33006, XENP33007, XENP33008, XENP33008, XENP33009, XENP33010, and XENP33011.

In some embodiments, examples of the heterodimeric Fc fusion protein comprise a first fusion protein having a polypeptide sequence selected from the group consisting of: i) SEQ ID NO:47 (XENP27201 Chain 1), ii) SEQ ID NO:85 (XenD24752), iii) SEQ ID NO:86 (XenD24753), iv) SEQ ID NO:87 (XenD24754), v) SEQ ID NO:88 (XenD24755), vi) SEQ ID NO:89 (XenD24756), vii) SEQ ID NO:90 (XenD24757), viii) SEQ ID NO:91 (XenD24758), ix) SEQ ID NO:92 (XenD24759), x) SEQ ID NO:93 (XenD24760), xi) SEQ ID NO:94 (XenD24761), xii) SEQ ID NO:95 (XenD24762), xiii) SEQ ID NO:96 (XenD24763), xiv) SEQ ID NO:97 (XenD24764), xv) SEQ ID NO:98 (XenD24765), xvi) SEQ ID NO:99 (XenD24766), xvii) SEQ ID NO:100 (XenD24767), xviii) SEQ ID NO:101 (XenD24768), xix) SEQ ID NO:102 (XenD24769), xx) SEQ ID NO:103 (XenD24770), xxi) SEQ ID NO:104 (XenD24771), xxii) SEQ ID NO:105 (XenD24772), xxiii) SEQ ID NO:106 (XenD24773), xxiv) SEQ ID NO:107 (XenD24774), xxv) SEQ ID NO:108 (XenD24775), xxvi) SEQ ID NO:109 (XenD24776), xxvii) SEQ ID NO:110 (XenD24777), xxviii) SEQ ID NO:111 (XenD24778), xxix) SEQ ID NO:112 (XenD24792), xxx) SEQ ID NO:215 (XenD25922), xxxi) SEQ ID NO:216 (XenD25923), xxxii) SEQ ID NO:217 (XenD25924), xxxiii) SEQ ID NO:218 (XenD25925), xxxiv) SEQ ID NO:219 (XenD25926), xxxv) SEQ ID NO:220(XenD25927), xxxvi) SEQ ID NO:221 (XenD25928), xxxvii) SEQ ID NO:222 (XenD25929), xxxviii) SEQ ID NO:223 (XenD25930), xxxix) SEQ ID NO:224 (XenD25931), xl) SEQ ID NO:291 (XenD26411), xli) SEQ ID NO:292 (XenD26412), xlii) SEQ ID NO:293 (XenD26413),xliii) SEQ ID NO:294 (XenD26414), xliv) SEQ ID NO:295 (XenD26415), xlv) SEQ ID NO:296 (XenD26416), xlvi) SEQ ID NO:297 (XenD26417),xlvii) SEQ ID NO:298 (XenD26418), xlviii) SEQ ID NO:301 (XenD27070),xlix) SEQ ID NO:302 (XenD27071), l) SEQ ID NO:303 (XenD27072), li) SEQ ID NO:304 (XenD27073), lii) SEQ ID NO:305 (XenD27074),liii) SEQ ID NO:306 (XenD27075),liv) SEQ ID NO:307 (XenD27076),lv) SEQ ID NO:308 (XenD27077) lvi) SEQ ID NO:309 (XenD27078),lvii) SEQ ID NO:317 (XenD28173),lviii) SEQ ID NO:318 (XenD24876),lix) SEQ ID NO:320 (XenD27162),lx) SEQ ID NO:321 (XenD27163),lxi) SEQ ID NO:323 (XenD27164),lxii) SEQ ID NO:324 (XenD27165) lxiii) SEQ ID NO:357 (XENP31582 Chain 1),lxiv) SEQ ID NO:358 (XENP31583 Chain 1),lxv) SEQ ID NO:359 (XENP31584 Chain 1),lxvi) SEQ ID NO:380 (XENP32187 Chain 1), lxvii) SEQ ID NO:381 (XENP32188 Chain 1),lxviii) SEQ ID NO:382 (XENP32189, Chain 1), lxix) SEQ ID NO:425 (XENP32190 Chain 1), lxx) SEQ ID NO:384 (XENP32191 Chain 1),lxxi) SEQ ID NO:385 (XENP32991 Chain 1),lxxii) SEQ ID NO:386 (XENP32992 Chain 1),lxxiii) SEQ ID NO:387 (XENP32993 Chain 1),lxxiv) SEQ ID NO:388 (XENP32994 Chain 1),lxxv) SEQ ID NO:389 (XENP32995 Chain 1),lxxvi) SEQ ID NO:390 (XENP32996 Chain 1), lxxvi) SEQ ID NO:391 (XENP32997 Chain 1), lxxvii) SEQ ID NO:392 (XENP32998 Chain 1),lxxvii) SEQ ID NO:393 (XENP32999 Chain 1),lxxviii) SEQ ID NO:394 (XENP33000 Chain 1), lxxix) SEQ ID NO:395 (XENP33001 Chain 1), lxxx) SEQ ID NO:3% (XENP33002 Chain 1), lxxxi) SEQ ID NO:397 (XENP33003 Chain 1), lxxxii) SEQ ID NO:398 (XENP33004 Chain 1), lxxxiii) SEQ ID NO:426 (XENP33005 Chain 1),lxxxiv) SEQ ID NO:427 (XENP33006 Chain 1), lxxxv) SEQ ID NO:428 (XENP33007 Chain 1), lxxxvi) SEQ ID NO:429 (XENP33008 Chain 1), lxxxvii) SEQ ID NO:429 (XENP33008 Chain 1),lxxxviii) SEQ ID NO:430 (XENP33009 Chain 1),lxxxix) SEQ ID NO:431 (XENP33010 Chain 1), and xc) SEQ ID NO:383 (XENP33011 Chain 1); and said second fusion protein having a polypeptide sequence selected from the group consisting of: i) SEQ ID NO:48 (XENP27201 Chain 2),ii) SEQ ID NO:126 (XenD24779), iii) SEQ ID NO:127 (XenD24780), iv) SEQ ID NO:128 (XenD24781), v) SEQ ID NO:129 (XenD24782), vi) SEQ ID NO:130 (XenD24783), vii) SEQ ID NO:131 (XenD24784), viii) SEQ ID NO:132 (XenD24785), ix) SEQ ID NO:133 (XenD24786), x) SEQ ID NO:134 (XenD24787), xi) SEQ ID NO:135 (XenD24788), xii) SEQ ID NO:136 (XenD24789), xiii) SEQ ID NO:137 (XenD24790), xiv) SEQ ID NO:138 (XenD24791), xv) SEQ ID NO:236 (XenD25911), xvi) SEQ ID NO:237 (XenD25912), xvii) SEQ ID NO:238 (XenD25913), xviii) SEQ ID NO:239 (XenD25914), xix) SEQ ID NO:240 (XenD25915), xx) SEQ ID NO:241 (XenD25916), xxi) SEQ ID NO:242 (XenD25917), xxii) SEQ ID NO:243 (XenD25918), xxiii) SEQ ID NO:244 (XenD25919), xxiv) SEQ ID NO:245 (XenD25920), xxv) SEQ ID NO:246 (XenD25921),xxvi) SEQ ID NO:299 (XenD26427), xxvii) SEQ ID NO:300 (XenD26428),xxviii) SEQ ID NO:311 (XenD27089),xxix) SEQ ID NO:312 (XenD27090),xxx) SEQ ID NO:313 (XenD27091),xxxi) SEQ ID NO:314 (XenD27092), xxxii)

SEQ ID NO:315 (XenD27093),xxxiii) SEQ ID NO:316 (XenD27094),xxxix) SEQ ID NO:319 (XenD24877),xl) SEQ ID NO:322 (XenD27166),xli) SEQ ID NO:421 (XENP31582 Chain 2),xlii) SEQ ID NO:422 (XENP31583 Chain 2), xliii) SEQ ID NO:423 (XENP31584 Chain 2), xliv) SEQ ID NO:402 (XENP32187 Chain 2), xlv) SEQ ID NO:403 (XENP32188 Chain 2), xlvi) SEQ ID NO:404 (XENP32189, Chain 2), xlvii) SEQ ID NO:405 (XENP32190 Chain 2), xlviii) SEQ ID NO:406 (XENP32191 Chain 2), xlix) SEQ ID NO:407 (XENP32991 Chain 2), l) SEQ ID NO:408 (XENP32992 Chain 2), li) SEQ ID NO:409 (XENP32993 Chain 2), lii) SEQ ID NO:410 (XENP32994 Chain 2), liii) SEQ ID NO:411 (XENP32995 Chain 2), liv) SEQ ID NO:412 (XENP32996 Chain 2), lv) SEQ ID NO:413 (XENP32997 Chain 2), lvi) SEQ ID NO:414 (XENP32998 Chain 2), lvii) SEQ ID NO:415 (XENP32999 Chain 2), lviii) SEQ ID NO:416 (XENP33000 Chain 2), lix) SEQ ID NO:417 (XENP33001 Chain 2), lx) SEQ ID NO:418 (XENP33002 Chain 2), lxi) SEQ ID NO:419 (XENP33003 Chain 2), lxii) SEQ ID NO:420 (XENP33004 Chain 2), lxiii) SEQ ID NO:399 (XENP33005 Chain 2), lxiv) SEQ ID NO:400 (XENP33006 Chain 2), lxv) SEQ ID NO:401 (XENP33007 Chain 2), lxvi) SEQ ID NO:289 (XENP33008 Chain 2), lxvii) SEQ ID NO:289 (XENP33008 Chain 2), lxviii) SEQ ID NO:290 (XENP33009 Chain 2), lxix) SEQ ID NO:352 (XENP33010 Chain 2), and lxx) SEQ ID NO:354 (XENP33011 Chain 2).

Preferred embodiments include XENP31251, XENP31254, XENP31258, XENP32186, XENP32187, XENP32188, XENP32189, XENP32190, and XENP32191. In further embodiments, XENP31251, XENP31254, XENP31258, XENP32186, XENP32187, XENP32188, XENP32189, XENP32190, and XENP32191 include further glycoengineering.

IX. Nucleic Acids of the Invention

The invention further provides nucleic acid compositions encoding the heterodimeric Fc fusion protein, the IL-12 subunits, and the IL-12 heterodimeric complex of the invention (or, in the case of a monomer Fc domain protein, nucleic acids encoding those as well).

As will be appreciated by those in the art, the nucleic acid compositions will depend on the format of the heterodimeric protein. Thus, for example, when the format requires three amino acid sequences, three nucleic acid sequences can be incorporated into one or more expression vectors for expression. Similarly for some formats, only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric Fc fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids are contained on a different expression vector.

The heterodimeric Fc fusion protein of the invention are made by culturing host cells comprising the expression vector(s) as is well known in the art. Once produced, traditional fusion protein or antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that each monomer has a different pI and the heterodimer also has a distinct pI, thus facilitating isoelectric purification of the heterodimer (e.g., anionic exchange chromatography, cationic exchange chromatography). These substitutions also aid in the determination and monitoring of any contaminating homodimers post-purification (e.g., IEF gels, cIEF, and analytical IEX columns).

X. Biological and Biochemical Functionality of IL-12 Heterodimeric Immunomodulatory Fc Fusion Proteins Generally the Fc fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on $CD4^+$ T cell activation or proliferation, $CD8^+$ T (CTL) cell activation or proliferation, $CD8^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL0, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy and Potency

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. IL-12 mediates IFNγ expression and secretion through phosphorylation of STAT4 (Morinobu et al., 2002). Accordingly, in a preferred embodiment, the signaling pathway assay measures increases or decreases in immune response as indicated by phosphorylation of STAT4. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g., CD25, CD69, CD137, PD1), cytotoxicity (ability to kill target cells), and cytokine production (e.g., IL-2, IL-4, IL-6, IFN$\gamma$, TNF-$\alpha$, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g., IFN$\gamma$ and TNF), and cell surface receptor expression (e.g. CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an IL-12 heterodimeric fusion protein of the invention. Similarly, increases of at least one-, two-, three-, four- or five-fold as compared to reference or control samples show efficacy.

XI. Combination Therapy

In some aspects, the IL-12-Fc fusion proteins described herein is administered in combination with another therapeutic agent. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

The IL-12-Fc fusion proteins (e.g., any XENP sequence described herein) described herein and the at least one additional therapeutic agent can be administered simultaneously, in the same or in separate compositions, or sequentially. For sequential administration, the IL-12-Fc fusion proteins (e.g., any XENP sequence described herein) described herein can be administered first, and the additional agent can be administered second, or the order of administration can be reversed.

The IL-12-Fc fusion proteins (e.g., any XENP sequence described herein) described herein and/or other therapeutic agents, procedures or modalities can be administered during periods of active disorder, or during a period of remission or less active disease. The IL-12-Fc fusion proteins (e.g., any XENP sequence described herein) can be administered before the other treatment, concurrently with the treatment, post-treatment, or during remission of the disorder.

A. Checkpoint Blockade Antibodies

In some embodiments, the IL-12-Fc fusion proteins described herein are combined with other therapeutic agents including checkpoint blockade antibodies, such as but not limited to, a PD-1 inhibitor, a TIM3 inhibitor, a CTLA4 inhibitor, a PD-L1 inhibitor, a TIGIT inhibitor, a LAG3 inhibitor, or a combination thereof.

1. Anti-PD-1 Antibodies

In some embodiments, an IL-12-Fc fusion protein described herein can be administered to a subject with cancer in combination with an anti-PD-1 antibody. In some cases, the anti-PD-1 antibody includes XENP16432 (a bivalent anti-PD-1 mAb, a checkpoint inhibitor which enhances anti-tumor activity by de-repressing the engrafted human T cells; sequences depicted in FIG. 53).

In some embodiments, the Il-12-Fc fusion proteins of the invention are administered in combination with Keytruda® or Optivo®.

Exemplary non-limiting anti-PD-1 antibody molecules are disclosed in US 2015/0210769, published on Jul. 30, 2015, entitled "Antibody Molecules to PD-1 and Uses Thereof," incorporated by reference in its entirety.

In one embodiment, the anti-PD-1 antibody molecule includes at least one or two heavy chain variable domain (optionally including a constant region), at least one or two light chain variable domain (optionally including a constant region), or both, comprising the amino acid sequence of BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences. The anti-PD-1 antibody molecule, optionally, comprises a leader sequence from a heavy chain, a light chain, or both, as shown in Table 4 of US 2015/0210769; or a sequence substantially identical thereto.

In yet another embodiment, the anti-PD-1 antibody molecule includes at least one, two, or three complementarity determining regions (CDRs) from a heavy chain variable region and/or a light chain variable region of an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-1 antibody molecule includes at least one, two, or three CDRs (or collectively all of the CDRs) from a heavy chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-1 antibody molecule includes at least one, two, or three CDRs (or collectively all of the CDRs) from a light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-1 antibody molecule includes a substitution in a light chain CDR, e.g., one or more substitutions in a CDR1, CDR2 and/or CDR3 of the light chain. In one embodiment, the anti-PD-1 antibody molecule includes a substitution in the light chain CDR3 at position 102 of the light variable region, e.g., a substitution of a cysteine to tyrosine, or a cysteine to serine residue, at position 102 of the light variable region according to Table 1 (e.g., SEQ ID NO: 16 or 24 for murine or chimeric, unmodified; or any of SEQ ID NOs: 34, 42, 46, 54, 58, 62, 66, 70, 74, or 78 for a modified sequence).

In another embodiment, the anti-PD-1 antibody molecule includes at least one, two, three, four, five or six CDRs (or collectively all of the CDRs) from a heavy and light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-1 antibody molecule includes:
(a) a heavy chain variable region (VH) comprising a VHCDR1 amino acid sequence of SEQ ID NO: 4, a VHCDR2 amino acid sequence of SEQ ID NO: 5, and a VHCDR3 amino acid sequence of SEQ ID NO: 3; and a light chain variable region (VL) comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769;

(b) a VH comprising a VHCDR1 amino acid sequence chosen from SEQ ID NO: 1; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769;

(c) a VH comprising a VHCDR1 amino acid sequence of SEQ ID NO: 224, a VHCDR2 amino acid sequence of SEQ ID NO: 5, and a VHCDR3 amino acid sequence of SEQ ID NO: 3; and a VL comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769; or (d) a VH comprising a VHCDR1 amino acid sequence of SEQ ID NO: 224; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769.

In another embodiment, the anti-PD-1 antibody molecule comprises (i) a heavy chain variable region (VH) comprising a VHCDR1 amino acid sequence chosen from SEQ ID NO: 1, SEQ ID NO: 4, or SEQ ID NO: 224; a VHCDR2 amino acid sequence of SEQ ID NO: 2 or SEQ ID NO: 5; and a VHCDR3 amino acid sequence of SEQ ID NO: 3; and (ii) a light chain variable region (VL) comprising a VLCDR1 amino acid sequence of SEQ ID NO: 10 or SEQ ID NO: 13, a VLCDR2 amino acid sequence of SEQ ID NO: 11 or SEQ ID NO: 14, and a VLCDR3 amino acid sequence of SEQ ID NO: 32 or SEQ ID NO: 33, each disclosed in Table 1 of US 2015/0210769.

In other embodiments, the PD-1 inhibitor is an anti-PD-1 antibody chosen from nivolumab, pembrolizumab, or pidilizumab.

In some embodiments, the anti-PD-1 antibody is nivolumab. Alternative names for nivolumab include MDX-1106, MDX-1106-04, ONO-4538, or BMS-936558. In some embodiments, the anti-PD-1 antibody is Nivolumab (CAS Registry Number: 946414-94-4). Nivolumab is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. In one embodiment, the inhibitor of PD-1 is nivolumab, and having a sequence disclosed herein (or a sequence substantially identical or similar thereto, e.g., a sequence at least 85%, 90%, 95% identical or higher to the sequence specified). In some embodiments, the anti-PD-1 antibody is pembrolizumab. Pembrolizumab (also referred to as lambrolizumab, MK-3475, MK03475, SCH-900475 or KEYTRUDA®; Merck) is a humanized IgG4 monoclonal antibody that binds to PD-1. Pembrolizumab and other humanized anti-PD-1 antibodies are disclosed in Hamid, O. et al. (2013) New England Journal of Medicine 369 (2): 134-44, U.S. Pat. No. 8,354,509 and WO2009/114335.

In one embodiment, the inhibitor of PD-1 is pembrolizumab disclosed in, e.g., U.S. Pat. No. 8,354,509 and WO 2009/114335, and having a sequence disclosed herein (or a sequence substantially identical or similar thereto, e.g., a sequence at least 85%, 90%, 95% identical or higher to the sequence specified).

In some embodiments, the anti-PD-1 antibody is pidilizumab. Pidilizumab (CT-011; Cure Tech) is a humanized IgG1k monoclonal antibody that binds to PD1. Pidilizumab and other humanized anti-PD-1 monoclonal antibodies are disclosed in U.S. Pat. No. 8,747,847 and WO2009/101611.

Other anti-PD1 antibodies include AMP 514 (Amplimmune), among others, e.g., anti-PD1 antibodies disclosed in U.S. Pat. No. 8,609,089, US 2010028330, and/or US 20120114649.

In some embodiments, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In some embodiments, the PD-1 inhibitor is AMP-224 (B7-DCIg; Amplimmune; e.g., disclosed in WO2010/027827 and WO2011/066342), is a PD-L2 Fc fusion soluble receptor that blocks the interaction between PD-1 and B7-H1.

In some embodiments, anti-PD-1 antibodies can be used in combination with an IL-12 Fc fusion protein of the invention. There are several anti-PD-1 antibodies including, but not limited to, two currently FDA approved antibodies, pembrolizumab and nivolizumab, as well as those in clinical testing currently, including, but not limited to, tislelizumab, Sym021, REGN2810 (developed by Rengeneron), JNJ-63723283 (developed by J and J), SHR-1210, pidilizumab, AMP-224, MEDIo680, PDR001 and CT-001, as well as others outlined in Liu et al., J. Hemat. & Oncol. (2017) 10:136, the antibodies therein expressly incorporated by reference.

In some embodiments, an IL-12-Fc fusion protein described herein can be used in combination with a PD-1 inhibitor (e.g., an anti-PD-1 antibody). In certain embodiments, an IL-12-Fc fusion protein (e.g., any XENP sequence described herein) described herein is administered in combination with an anti-PD-1 antibody.

2. Anti-TIM3 Antibodies

In some embodiments, the IL-12-Fc fusion proteins of the invention are administered in combination with an anti-TIM3 antibody.

In some embodiments, the I1-12-Fc fusion proteins of the invention are administered in combination with LY3321367 (Eli Lilly and Company), MBG453 (Novartis Pharmaceuticals), and TSR-022 (Tesaro, Inc.).

Exemplary non-limiting anti-TIM-3 antibody molecules are disclosed in US 2015/0218274, published on Aug. 6, 2015, entitled "Antibody Molecules to TIM-3 and Uses Thereof," incorporated by reference in its entirety.

In one embodiment, the anti-TIM-3 antibody molecule includes at least one or two heavy chain variable domain (optionally including a constant region), at least one or two light chain variable domain (optionally including a constant region), or both, comprising the amino acid sequence of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences. The anti-TIM-3 antibody molecule, optionally, comprises a leader sequence from a heavy chain, a light chain, or both, as shown in US 2015/0218274; or a sequence substantially identical thereto.

In yet another embodiment, the anti-TIM-3 antibody molecule includes at least one, two, or three complementarity determining regions (CDRs) from a heavy chain variable region and/or a light chain variable region of an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In yet another embodiment, the anti-TIM-3 antibody molecule includes at least one, two, or three CDRs (or collectively all of the CDRs) from a heavy chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Table 1-4.

In yet another embodiment, the anti-TIM-3 antibody molecule includes at least one, two, or three CDRs (or collectively all of the CDRs) from a light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4. In certain embodiments, the anti-TIM-3 antibody molecule includes a substitution in a light chain CDR, e.g., one or more substitutions in a CDR1, CDR2 and/or CDR3 of the light chain.

In another embodiment, the anti-TIM-3 antibody molecule includes at least one, two, three, four, five or six CDRs (or collectively all of the CDRs) from a heavy and light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4.

In one embodiment, the anti-TIM-3 antibody molecule includes:
(a) a heavy chain variable region (VH) comprising a VHCDR1 amino acid sequence chosen from SEQ ID NO: 9; a VHCDR2 amino acid sequence of SEQ ID NO: 10; and a VHCDR3 amino acid sequence of SEQ ID NO: 5; and a light chain variable region (VL) comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;
(b) a VH comprising a VHCDR1 amino acid sequence chosen from SEQ ID NO: 3; a VHCDR2 amino acid sequence of SEQ ID NO: 4; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;
(c) a VH comprising a VHCDR1 amino acid sequence chosen from SEQ ID NO: 9; a VHCDR2 amino acid sequence of SEQ ID NO: 25; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;
(d) a VH comprising a VHCDR1 amino acid sequence chosen from SEQ ID NO: 3; a VHCDR2 amino acid sequence of SEQ ID NO: 24; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;
(e) a VH comprising a VHCDR1 amino acid sequence chosen from SEQ ID NO: 9; a VHCDR2 amino acid sequence of SEQ ID NO: 31; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274; or
(f) a VH comprising a VHCDR1 amino acid sequence chosen from SEQ ID NO: 3; a VHCDR2 amino acid sequence of SEQ ID NO: 30; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274.

Exemplary anti-TIM-3 antibodies are disclosed in U.S. Pat. No. 8,552,156, WO 2011/155607, EP 2581113 and U.S Publication No.: 2014/044728.

In some embodiments, anti-TIM-3 antibodies can be used in combination an IL-12 Fc fusion protein of the invention. There are several TIM-3 antibodies in clinical development, including, but not limited to, MBG453 and TSR-022.

In some embodiments, an IL-12-Fc fusion protein described herein can be used in combination with a TIM-3 inhibitor (e.g., an anti-TIM3 antibody). In certain embodiments, an IL-12 Fc fusion protein (e.g., any XENP sequence described herein) described herein is administered in combination with an anti-TIM3 antibody.

3. Anti-CTLA4 Antibodies

Exemplary anti-CTLA4 antibodies include tremelimumab (IgG2 monoclonal antibody available from Pfizer, formerly known as ticilimumab, CP-675,206); and ipilimumab (CTLA-4 antibody, also known as MDX-010, CAS No. 477202-00-9). Other exemplary anti-CTLA-4 antibodies are disclosed, e.g., in U.S. Pat. No. 5,811,097.

In one embodiment, the anti-CTLA4 antibody is ipilimumab disclosed in, e.g., U.S. Pat. Nos. 5,811,097, 7,605,238, WO0/32231 and WO97/20574, and having a sequence disclosed herein (or a sequence substantially identical or similar thereto, e.g., a sequence at least 85%, 90%, 95% identical or higher to the sequence specified).

In one embodiment, the anti-CTLA4 antibody is tremelimumab disclosed in, e.g., U.S. Pat. No. 6,682,736 and WO0/37504, and having a sequence disclosed herein (or a sequence substantially identical or similar thereto, e.g., a sequence at least 85%, 90%, 95% identical or higher to the sequence specified).

In some embodiments, anti-CTLA-4 antibodies can be used in combination with an IL-12-Fc fusion protein of the invention. Thus, suitable anti-CTLA-4 antibodies for use in combination therapies as outlined herein include, but are not limited to, one currently FDA approved antibody ipilimumab, and several more in development, including CP-675, 206 and AGEN-1884.

In some embodiments, an IL-12-Fc fusion protein described herein can be used in combination with a CTLA-4 inhibitor (e.g., an anti-CTLA-4 antibody). In certain embodiments, an IL-12-Fc fusion proteins (e.g., any XENP sequence described herein) described herein is administered in combination with an anti-CTLA-4 antibody.

4. Anti-PD-L1 Antibodies

Exemplary non-limiting anti-PD-L1 antibody molecules are disclosed in US 2016/0108123, published on Apr. 21, 2016, entitled "Antibody Molecules to PD-L1 and Uses Thereof," incorporated by reference in its entirety.

In one embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three complementarity determining regions (CDRs) from a heavy chain variable region and/or a light chain variable region of an antibody described herein, e.g., an antibody chosen from any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three CDRs (or collectively all of the CDRs) from a heavy chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-L1 antibody molecule includes at least one, two, or three CDRs (or collectively all of the CDRs) from a light chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-PD-L1 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2016/0108123. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 2; and a VHCDR3 amino acid sequence of SEQ ID NO: 3, each disclosed in Table 1 of US 2016/0108123; and (ii) a light chain variable region (VL) including a VLCDR1 amino acid sequence of SEQ ID NO: 9, a VLCDR2 amino acid sequence of SEQ ID NO: 10, and a VLCDR3 amino acid sequence of SEQ ID NO: 11, each disclosed in Table 1 of US 2016/0108123.

In another embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 5, and a VHCDR3 amino acid sequence of SEQ ID NO: 3, each disclosed in Table 1 of US 2016/0108123; and (ii) a light chain variable region (VL) including a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Table 1 of US 2016/0108123.

In one embodiment, the anti-PD-L1 antibody molecule comprises the VHCDR1 amino acid sequence of SEQ ID NO: 1. In another embodiment, the anti-PD-L1 antibody molecule comprises the VHCDR1 amino acid sequence of SEQ ID NO: 4. In yet another embodiment, the anti-PD-L1 antibody molecule comprises the VHCDR1 amino acid sequence of SEQ ID NO: 195, each disclosed in Table 1 of US 2016/0108123.

In some embodiments, the PD-L1 inhibitor is an antibody molecule. In some embodiments, the anti-PD-L1 inhibitor is chosen from YW243.55.S70, MPDL3280A, MEDI-4736, MSB-0010718C, MDX-1105, atezolizumab, durbalumab, avelumab, or BMS936559.

In some embodiments, the anti-PD-L1 antibody is atezolizumab. Atezolizumab (also referred to as MPDL3280A and Atezo@; Roche) is a monoclonal antibody that binds to PD-L1. Atezolizumab and other humanized anti-PD-L1 antibodies are disclosed in U.S. Pat. No. 8,217,149, and having a sequence disclosed herein (or a sequence substantially identical or similar thereto, e.g., a sequence at least 85%, 90%, 95% identical or higher to the sequence specified).

In some embodiments, the anti-PD-L1 antibody is avelumab. Avelumab (also referred to as A09-246-2; Merck Serono) is a monoclonal antibody that binds to PD-L. Avelumab and other humanized anti-PD-L1 antibodies are disclosed in U.S. Pat. No. 9,324,298 and WO2013/079174, and having a sequence disclosed herein (or a sequence substantially identical or similar thereto, e.g., a sequence at least 85%, 90%, 95% identical or higher to the sequence specified).

In some embodiments, the anti-PD-L1 antibody is durvalumab. Durvalumab (also referred to as MEDI4736; AstraZeneca) is a monoclonal antibody that binds to PD-L1. Durvalumab and other humanized anti-PD-L1 antibodies are disclosed in U.S. Pat. No. 8,779,108, and having a sequence disclosed herein (or a sequence substantially identical or similar thereto, e.g., a sequence at least 85%, 90%, 95% identical or higher to the sequence specified).

In some embodiments, the anti-PD-L1 antibody is BMS-936559. BMS-936559 (also referred to as MDX-1105; BMS) is a monoclonal antibody that binds to PD-L. BMS-936559 and other humanized anti-PD-L1 antibodies are disclosed in U.S. Pat. No. 7,943,743 and WO2007005874, and having a sequence disclosed herein (or a sequence substantially identical or similar thereto, e.g., a sequence at least 85%, 90%, 95% identical or higher to the sequence specified).

In some embodiments, anti-PD-L1 antibodies can be used in combination with an IL-12-Fc fusion protein of the invention. There are several anti-PD-L1 antibodies including three currently FDA approved antibodies, atezolizumab, avelumab, durvalumab, as well as those in clinical testing currently, including, but not limited to, LY33000054 and CS1001, as well as others outlined in Liu et al., J. Hemat. & Oncol. (2017) 10:136, the antibodies therein expressly incorporated by reference.

In some embodiments, an IL-12-Fc fusion protein described herein can be used in combination with a PD-L1 or PD-L2 inhibitor (e.g., an anti-PD-L1 antibody).

5. Anti-TIGIT Antibodies

In some embodiments, the anti-TIGIT antibody is OMP-313M32. OMP-313M32 (OncoMed Pharmaceuticals) is a monoclonal antibody that binds to TIGIT. OMP-313M32 and other humanized anti-TIGIT antibodies are disclosed in US20160376365 and WO2016191643, and having a sequence disclosed herein (or a sequence substantially identical or similar thereto, e.g., a sequence at least 85%, 90%, 95% identical or higher to the sequence specified).

In some embodiments, the anti-TIGIT antibody is BMS-986207. BMS-986207 (also referred to as ONO-4686; Bristol-Myers Squibb) is a monoclonal antibody that binds to TIGIT. BMS-986207 and other humanized anti-TIGIT antibodies are disclosed in US20160176963 and WO2016106302, and having a sequence disclosed herein (or a sequence substantially identical or similar thereto, e.g., a sequence at least 85%, 90%, 95% identical or higher to the sequence specified).

In some embodiments, the anti-TIGIT antibody is MTIG7192. MTIG7192 (Genentech) is a monoclonal antibody that binds to TIGIT. MTIG7192 and other humanized anti-TIGIT antibodies are disclosed in US2017088613, WO2017053748, and WO2016011264, and having a sequence disclosed herein (or a sequence substantially identical or similar thereto, e.g., a sequence at least 85%, 90%, 95% identical or higher to the sequence specified).

In some embodiments, anti-TIGIT antibodies can be used in combination with an IL-12-Fc fusion protein of the invention. There are several TIGIT antibodies in clinical development, BMS-986207, OMP-313M32 and MTIG7192A.

In some embodiments, an IL-12-Fc fusion protein described herein can be used in combination with a TIGIT inhibitor (e.g., an anti-TIGIT antibody). In certain embodiments, an IL-12-Fc fusion protein (e.g., any XENP sequence described herein) described herein is administered in combination with an anti-TIGIT antibody.

6. Anti-LAG3 Antibodies

Exemplary non-limiting anti-LAG-3 antibody molecules are disclosed in US 2015/0259420 published on Sep. 17, 2015, entitled "Antibody Molecules to LAG-3 and Uses Thereof," incorporated by reference in its entirety.

In one embodiment, the anti-LAG-3 antibody molecule includes at least one or two heavy chain variable domain (optionally including a constant region), at least one or two light chain variable domain (optionally including a constant region), or both, comprising the amino acid sequence of any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three complementarity determining regions (CDRs) from a heavy chain variable region and/or a light chain variable region of an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050- hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three CDRs (or collectively all of the CDRs) from a heavy chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-LAG-3 antibody molecule includes at least one, two, or three CDRs (or collectively all of the CDRs) from a light chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-LAG-3 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2015/0259420. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-LAG-3 antibody molecule includes:
(i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 2; and a VHCDR3 amino acid sequence of SEQ ID NO: 3, each disclosed in Table 1 of US 2015/0259420; and
(ii) a light chain variable region (VL) including a VLCDR1 amino acid sequence of SEQ ID NO: 10, a VLCDR2 amino acid sequence of SEQ ID NO: 11, and a VLCDR3 amino acid sequence of SEQ ID NO: 12, each disclosed in Table 1 of US 2015/0259420.

In another embodiment, the anti-LAG-3 antibody molecule includes:
(i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 5, and a VHCDR3 amino acid sequence of SEQ ID NO: 3, each disclosed in Table 1 of US 2015/0259420; and
(ii) a light chain variable region (VL) including a VLCDR1 amino acid sequence of SEQ ID NO: 13, a VLCDR2 amino acid sequence of SEQ ID NO: 14, and a VLCDR3 amino acid sequence of SEQ ID NO: 15, each disclosed in Table 1 of US 2015/0259420.

In one embodiment, the anti-LAG-3 antibody molecule comprises the VHCDR1 amino acid sequence of SEQ ID NO: 1. In another embodiment, the anti-LAG-3 antibody molecule comprises the VHCDR1 amino acid sequence of SEQ ID NO: 4. In yet another embodiment, the anti-LAG-3 antibody molecule comprises the VHCDR1 amino acid sequence of SEQ ID NO: 286, each disclosed in Table 1 of US 2015/0259420.

In some embodiments, the anti-LAG-3 antibody is BMS-986016. BMS-986016 (also referred to as BMS986016; Bristol-Myers Squibb) is a monoclonal antibody that binds to LAG-3. BMS-986016 and other humanized anti-LAG-3 antibodies are disclosed in US 2011/0150892, WO2010/019570, and WO2014/008218.

In some embodiments, the anti-LAG3 antibody is LAG525. LAG525 (also referred to as IMP701; Novartis) is a monoclonal antibody that binds to LAG3. LAG525 and other humanized anti-LAG3 antibodies are disclosed in U.S. Pat. No. 9,244,059 and WO2008132601, and having a sequence disclosed herein (or a sequence substantially identical or similar thereto, e.g., a sequence at least 85%, 90%, 95% identical or higher to the sequence specified).

Other exemplary anti-LAG3 antibodies are disclosed, e.g., in US2011150892 and US2018066054.

In some embodiments, anti-LAG-3 antibodies can be used in combination with an IL-12-Fc fusion protein of the invention. There are several anti-LAG-3 antibodies in clinical development including REGN3767, by Regeneron, BMS-986016 (Bristol-Myers Squibb), MK-4280 (Merck), LAG525 (Novartis), and TSR-033 (Tesaro).

In some embodiments, an IL-12-Fc fusion protein described herein can be used in combination with a LAG3 inhibitor (e.g., an anti-LAG3 antibody). In certain embodiments, an IL-12-Fc fusion protein (e.g., any XENP sequence described herein) described herein is administered in combination with an anti-LAG3 antibody.

XII. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the heterodimeric compositions of the invention find use in the treatment of these cancers.

A. Fusion Protein Compositions for In Vivo Administration

Formulations of the fusion proteins used in accordance with the present invention are prepared for storage by mixing a fusion protein having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions.

B. Administrative Modalities

The fusion proteins and chemotherapeutic agents of the invention are administered to a subject, in accord with known methods, such as intravenous administration as a bolus or by continuous infusion over a period of time.

B. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the protein or protein portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the heterodimeric proteins used in the present invention depend on the disease or condition to be treated and may be determined by the persons skilled in the art.

An exemplary, non-limiting range for a therapeutically effective amount of an heterodimeric proteins used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

Example 1: IL-12-Fc Fusion Proteins

As with other cytokines, IL-12 has a short half-life, and high dose treatment to overcome the short half-life results in systemic toxicity. Additionally, it has also been reported that anti-tumor effect requires sustained induction of IFNγ production by IL-12 (Gollob, J A et al., 2000). Further, the IL-12p40 subunit, as either a monomer or a homodimer, has been reported to antagonize IL-12 activity by competing for binding to IL-12 receptors (Gillessen, S et al., 1995); accordingly, it is advantageous to pre-complex the IL-12p40 and IL-12p35 subunits. In order to address these two caveats, we engineered the IL-12 heterodimer as Fc fusion proteins (collectively referred to hereon as IL-12-Fc fusions) both to enhance circulation through FcRn-mediated recycling and to pre-complex the IL-12p40 and IL-12p35 subunits.

1A: Engineering IL-12-Fc Fusions in Various Formats

We generated the N-terminal IL-12 heterodimeric Fc fusion or "IL-12-heteroFc" format which comprises the IL-12p40 subunit recombinantly fused to the N-terminus of one side of a heterodimeric Fc and the IL-12p35 subunit recombinantly fused to N-terminus of the other side of the heterodimeric Fc (FIG. 8A). The IL-12p40 and IL-12p35 subunits may be linked to their respective Fc chains by a domain linker. An illustrative protein of this format is XENP27201, sequences for which are depicted in FIG. 9.

We also generated the C-terminal IL-12 heterodimeric Fc fusion or "heteroFc-IL-12" format which comprises the IL-12p40 subunit recombinantly fused to the C-terminus of one side of a heterodimeric Fc and the IL-12p35 subunit recombinantly fused to the C-terminus of the other side of the heterodimeric Fc (FIG. 8B). The IL-12p30 and IL-12p35 subunits may be linked to their respective Fc chains by a domain linker. An illustrative protein of this format is XENP27202, sequences for which are depicted in FIG. 10.

We further generated the N-terminal single-chain IL-12-Fc fusion or "scIL-12-Fc" format which comprises a single-chain IL-12 complex (or "scIL-12 complex") recombinantly fused to the N-terminus of one side of a heterodimeric Fc (optionally via a domain linker), with the other side of the molecule being a "Fc-only" or "empty-Fc" heterodimeric Fc (FIG. 8C-D). The scIL-12 complex can comprise either IL-12p35 N-terminally linked to IL-12p40 or IL-12p40 N-terminally linked to IL-12p35, optionally with a domain linker. The order of the two subunits in the scIL-12 complex are designated herein as follows: "scIL-12(p40/p35)", wherein the IL-12p40 subunit is N-terminally linked to the IL-12p35 subunit, or "scIL-12(p35/p40)", wherein the IL-12p35 is N-terminally linked to the IL-12p35 subunit. Illustrative proteins of the scIL-12-Fc format include XENP27203 and XENP27204, sequences for which are depicted in FIG. 11.

Cartoon schematics for additional IL-12-Fc formats contemplated for use are depicted in FIG. 8.

1B: Production and Physical Characterization of Illustrative IL-12-Fc Fusions

1B(a): IL-12-heteroFc

Plasmids coding for the IL-12p35 and IL-12p40 subunits were constructed by standard gene synthesis, followed by subcloning into a pTT5 expression vector containing Fc fusion partners (e.g., constant regions as depicted in FIG. 7). Proteins were produced by transient transfection in HEK293E cells and were purified by a two-step purification process comprising protein A chromatography (purification part 1) followed by anion exchange chromatography (purification part 2). Chromatogram depicting purification part 2 for illustrative IL-12-heteroFc XENP27201 is depicted in FIG. 12A. The chromatogram shows the isolation of two peaks (peak A and peak B), which were further characterized by analytical size-exclusion chromatography with multi-angle light scattering (aSEC-MALS) and analytical anion-exchange chromatography (analytical AIEX) for identity, purity and homogeneity as generally described below.

Peaks A and B isolated from purification part 2 for XENP27201 were analyzed using aSEC-MALS to deduce their component protein species. The analysis was performed on an Agilent 1200 high-performance liquid chromatography (HPLC) system. Samples were injected onto a Superdex™ 200 10/300 GL column (GE Healthcare Life Sciences) at 1.0 mL/min using 1×PBS, pH 7.4 as the mobile phase at 4C for 25 minutes with UV detection wavelength at 280 nM. MALS was performed on a miniDAWN® TREOS® with an Optilab@ T-rEX Refractive Index Detector (Wyatt Technology, Santa Barbara, Cali.). Analysis was performed using Agilent OpenLab Chromatography Data System (CDS) ChemStation Edition AIC version C.01.07 and ASTRA version 6.1.7.15. Chromatograms depicting aSEC separation profiles for peaks A and B are depicted in FIG. 12B along with MW of component species as determined by MALS. The profiles show that peak A comprises species with molecular weights of ~299 kD and ~140 kD, while peak B primarily comprises a species with molecular weight of ~118 kD, which is consistent with the calculated molecular weight of XENP27201 (based on amino acid sequence) of 110.4 kDa taking into account additional mass contributed by glycans.

The peaks from purification part 2 were also analyzed using analytical AIEX to further assess the purity and homogeneity of peak B. The analysis was performed on an Agilent 1200 high-performance liquid chromatography (HPLC) system. Samples were injected onto a Proteomix SAX-NP5 5 µM non-porous column (Sepax Technologies, Inc., Newark, Del.) at 1.0 mL/min using 0-40% NaCl gradient in 20 mM Tris, pH 8.5 buffer with UV detection wavelength at 280 nM. Analysis was performed using Agilent OpenLAB CDS ChemStation Edition AIC version C.01.07. Chromatograms depicting analytical AIEX separation of peaks A and B are depicted in FIG. 12C. Consistent with the aSEC separation profile for peak B, the analytical AIEX separation profile for peak B illustrates the purity and homogeneity of species in peak B. From here on, XENP27201 refers to peak B as isolated from purification part 2 as depicted in FIG. 12A.

1B(b): scIL-12(p40/p35)-Fc

Plasmids coding for IL-12p40 recombinantly fused to IL-12p35 via a linker were constructed by standard gene synthesis, followed by subcloning into a pTT5 expression vector containing Fc fusion partners (e.g., constant regions as depicted in FIG. 7). Proteins were produced by transient transfection in HEK293E cells and were purified by a two-step purification process comprising protein A chromatography (purification part 1) and anion exchange chromatography (purification part 2).

Chromatogram depicting purification part 2 for illustrative scIL-12(p40/p35)-Fc fusion XENP27203 is depicted in FIG. 13A. As above, the chromatogram shows the isolation of two peaks, which were further characterized by aSEC-MALS and analytical AIEX for identity, purity and homogeneity as described in Example 1B(a), chromatograms for which are depicted in FIGS. 13B-C.

The aSEC separation profiles for peaks A and B isolated from purification part 2 of XENP27203 show that peak A comprises species with molecular weights of ~3% kD, ~188 kD, and ~118 kD, while peak B primarily comprises a species with molecular weight of ~118 kD, which is consistent with the calculated molecular weight of XENP27203 (based on amino acid sequence) of 111.3 kDa taking into account additional mass contributed by glycans. The peaks were also analyzed using analytical AIEX as described in Example 1B(a) to further investigate the purity and homogeneity of peak B. Consistent with the aSEC separation profile for peak B, the analytical AIEX separation profile for peak B (FIG. 13C) illustrates the purity and homogeneity of species in peak B. From here on, XENP27203 refers to peak B as isolated from anion exchange as depicted in FIG. 13A.

1C: In Vitro Activity of IL-12-Fc Fusions in Induction of STAT4 Phosphorylation

Following binding of cytokines to their receptors, Janus kinases (JAKs) associated with the cytokine receptors phosphorylate STAT proteins which then translocate into the nucleus to regulate further downstream processes. In particular, IL-12 mediates IFNγ expression and secretion through phosphorylation of STAT4 (Morinobu et al., 2002).

Accordingly, the ability of the above described IL-12-heteroFc (XENP27201) and scIL-12(p40/p35)-Fc (XENP27203) to induce STAT4 phosphorylation in various lymphocyte populations was investigated. Bivalent IL-12p35-Fc fusions and IL-12p40-Fc fusions (cartoon schematics and sequences for which are depicted in FIGS. 14-15) as well as recombinant IL-12 were used as controls.

Fresh PBMCs were activated by incubation with plate bound anti-CD3 (100 ng/ml) for 3 days. Following activation, PBMCs were then incubated with the indicated test articles at the indicated concentrations for 15 minutes at 37,C. Following incubation, PBMCs were first stained with anti-CD3-BUV395 (UCHT1), anti-CD4-BV605 (RPA-T4), anti-CD8-AF700 (SKI), anti-CD14-APC/Fire750 (M5E2), anti-CD20-PerCP/5.5 (2H7), anti-CD25-BV421 (M-A251), and anti-CD56-PE antibodies. Following the first stain, cells were permeabilized using PerFix EXPOSE (Beckman Coulter, Indianapolis, Ind.). Following permeabilization, cells were stained with anti-anti-CD45RA-BV510 (HI100), anti-FoxP3-AF488 (259D), and anti-pSTAT4-AF647 (38/p-Stat4) antibodies. Following the second staining, the cells were analyzed by flow cytometry to investigate STAT4 phosphorylation on various lymphocyte populations. Data depicting pSTAT4 MFI on various lymphocyte populations, indicating signaling by the IL-12-Fc fusions via IL-12 receptors, are depicted in FIG. 16.

The data show that both XENP27201 and XENP27203 were active in inducing STAT4 phosphorylation in various lymphocyte populations to a similar level as that induced by recombinant IL-12, while the bivalent IL-12p40-Fc (XENP27560) and bivalent IL-12p35-Fc (XENP27561) fusions were inactive. Notably, the two IL-12-Fc fusion formats demonstrated similar potency. Additionally, the ability of the purified IL-12-Fc fusion proteins to induce STAT4 phosphorylation in comparison to XENP27560 and XENP27561 confirms that that peak B isolated from purification part 2 for both XENP27201 and XENP27203 (as described in Example 1B) consisted of the active species comprising the complete IL-12 heterodimer.

Example 2: IL-12 Variants Engineered for Reduced Potency

In order to further prolong half-life as well as reduce potential for toxicity, we engineered IL-12 variants with decreased binding affinity for IL-12 receptors as we reasoned that this would decrease the antigen sink as well as reduce potency.

2A(a): Engineering IL-12p40 Variants

We first identified W15, P17, D18, A19, P20, G21, M23, L40, D41, Q42, S43, E45, L47, T54, I55, Q56, K58, E59, F60, G61, D62, Y66, and K84 as potential sites on IL-12p40 for introducing affinity-modulating substitutions (residues depicted in FIG. 17).

As a second strategy, by using the QuaSAR package in MOE software, we identified highly exposed aspartic acid, glutamic acid, asparagine, and glutamine residues (according to the water accessible surface area calculated using a radius of 1.4 Å for the water molecule and a polyhedral representation for each atom) in the IL-12p40 crystal structure (PDB code 3HMX) reasoning that these residues may contribute to binding between IL-12p40 and the IL-12 receptors. In particular, we focused our search on residues at which we could incorporate isosteric substitutions (i.e. Asn and Asp; and Gln and Glu), with the aim to minimize potential for immunogenicity, Accordingly, we identified E3, D7, E12, D14, D18, E22, D29, E32, E33, D41, Q42, E45, Q56, E59, D62, Q65, E73, E86, D93, D97, E100, N103, E110, D129, D142, Q144, E156, D161, N162, E166, E170, Q172, D174, E187, N200, D209, D214, N218, Q220, N226, Q229, E231, E235, Q256, E262, D265, D270, N281, Q289, and E299 which have an ASA score of at least 19 (residues and ASA scores depicted in FIG. 18).

As described above, the p40 subunit is shared by IL-12 and IL-23. Bloch et al. (2018) reported the crystal structure for IL-23 in complex with IL-23R and Nb22E11. As a third strategy, we reasoned that residues on the IL-12p40 subunit in contact with IL-23R may also be involved with binding the analogous receptor IL-12Rβ2 in the IL-12 receptor complex. Accordingly, using the crystal structure reported by Bloch et al. (PDB code 5MZV) and modeling in MOE software, we identified D87, G88, I89, W90, K104, and F106 as residues on IL-12p40 potentially in contact with IL-12Rβ2 (residues and predicted contact type depicted in FIG. 19).

Finally, to ensure that we do not disturb the natural interaction between the IL-12p40 and IL-12p35 subunits, we identified the following residues on IL-12p40 potentially in contact with IL-12p35 based on the crystal structure reported by Luo et al. (2010): K102, Y114, A176, C177, P178, A179, A180, E181, S183, P185, S204, F206, R208, T242, P243, S245, Y246, F247, S248, D290, R291, Y292, and Y293.

In view of the above we designed a number of IL-12p40 variants, in particular as described above, at residue at which isosteric substitutions could be introduced, with the aim to to reduce the affinity of the IL-12 heterodimer to IL-12 receptors. Substitutions to remove potential N-glycosylation sites in p40 were also designed to examine the impact of glycosylation on protein heterogeneity. Sequences for illustrative variants are depicted in FIG. 20. Plasmids coding for the IL-12p40 variants were constructed by standard gene synthesis, followed by subcloning into a pTT5 expression vector containing Fc fusion partners (e.g., constant regions as depicted in FIG. 7), corresponding amino acid sequences for which are depicted in FIG. 21.

2A(b): Engineering IL-12p35 Variants

As with the second strategy described above, we used the QuaSAR package in MOE software to identify highly exposed aspartic acid, glutamic acid, asparagine, and glutamine residues in the IL-12p35 crystal structure (PDB code 3HMX) reasoning that these residues may contribute to binding between the IL12 heterodimeric complex and the IL-12 receptors. Again, we focused here, in particular, on residues at which we could incorporate isosteric substitutions, to minimize the potential for immunogenicity. We identified Q35, E38, E46, D55, E67, N71, N76, N85, Q135, Q146, N151, E153, E162, and E163 which have an ASA score of at least 103 (residues and ASA scores depicted in FIG. 22).

As above, to ensure that we do not disturb the natural interaction between the IL-12p40 and IL-12p354 subunits, we identified the following residues on IL-12p35 potentially in contact with IL-12p40 based on the crystal structure reported by Luo et al. (2010): Q20, S44, E45, E46, H49, K54, T59, V60, E61, C63, L64, P65, E67, L68, S73, C74, R181, I182, R183, V185, T186, D188, R189, V190, S192, Y193, and A196.

In view of the above we designed a number of IL-12p35 variants with isosteric substitutions with the aim to reduce the affinity of the IL-12 heterodimer to IL-12 receptors. Substitutions to remove potential N-glycosylation sites in p35 were also designed to examine the impact of glycosylation on protein heterogeneity. Sequences for illustrative variants are depicted in FIG. 23. Plasmids coding for the IL-12p35 variants were constructed by standard gene synthesis, followed by subcloning into a pTT5 expression vector containing Fc fusion partners (e.g., constant regions as depicted in FIG. 7), corresponding amino acid sequences for which are depicted in FIG. 24.

2a(c): Screening IL-12-Fc Fusions Having Reduced Potency

Illustrative variant IL-12-Fc fusion proteins having the above described variant IL-12 subunits were designed with the view to generate IL-12-Fc fusions having reduced affinity for the IL-12 receptors in order to reduce potency, sequences for which are depicted in FIG. 25. We produced and purified the IL-12-Fc fusions as generally described in Example 1B, and investigated their activity in a pSTAT4 assay.

Human PBMCs were activated with 100 ng/ml anti-CD3 (OKT3) for 2 days. Activated PBMCs were then incubated with the indicated test articles at 37° C. for 15 minutes. Cells were then stained with anti-CD3-BUV395 (UCHT1), anti-CD4-BV605 (RPAT4), anti-CD8-AF700 (SKI), anti-CD25-BV510 (M-A251), anti-CD45RA-BV421 (HI100), anti-CD56-PE (N901), anti-FoxP3-AF488 (259D), and anti-pSTAT4-AF647 (38/p-Stat4) using PerFix EXPOSE kit (Beckman Coulter, Indianapolis, Ind.) and analyzed by flow cytometry.

Data showing induction of STAT4 phosphorylation on $CD4^+CD45RA^+CD25^+$ and $CD8^+CD45RA^+CD25^+$ T cells by IL-12-Fc fusion having IL-12p35 or IL-12p40 variants are depicted respectively in FIGS. 26 and 27. FIG. 28 depicts the EC50 of the various variant IL-12-Fc fusions and the fold decrease in EC50 relative to WT IL-12-Fc XENP27201. The data show that most of the IL-12-Fc fusions comprising variant IL-12p40 subunits or IL-12p30 subunits exhibit decreased potency in inducing STAT4 phosphorylation. Notably, E59Q and E235Q substitutions in the IL-12p40 subunit, and E153Q and N151D substitutions in the IL-12p35 substitutions were able to individually provide over 2-fold reduction in potency for the variant IL-12-Fc fusions. Additionally, IL-12p40 double- and triple-mutants comprising E59Q provided up to 6.5-fold reduction in potency.

Surprisingly, two variant IL-12-Fc fusions comprising IL-12p40(D87N) or IL-12p40(E262Q) exhibited an increase in potency. While we are interested in decreasing potency with the aim to decrease antigen sink and thereby increase the half-life of IL-12-Fc fusions, IL-12-Fc fusions having increased potency may find use in other contexts.

2B: Engineering IL-12p40 and IL-12p35 Variants (Round 2)

In order to engineer further IL-12p40 and IL-12p35 variants with the aim to reduce their affinity for the IL-12 receptors and reduce the potency of the biologically active IL-12 complex, we re-applied the strategies described in Examples 2A with expanded criteria. For example, we used a lower ASA score threshold than that defined in Examples 2A for identifying IL-12p40 and IL-12p35 residues at which to introduce substitutions. We also expanded our criteria to include additional amino acid residues, with a particular focus on larger residues such as lysine, at which introduction of substitutions was more likely to disrupt the interaction of IL-12p35, IL-12p40, and/or the IL-12 complex with the IL-12 receptors.

Similarly, we introduced non-isosteric substitutions, with a particular focus on larger residues such as lysine, to disrupt the interaction of IL-12p35, IL-12p40, and/or the IL-12 complex with the IL-12 receptors. Using these approaches, we further identified D34, K99, K163, K258, and K260 in the IL-12p40 subunit; and N21, E79, Q130, N136, E143, K158, and D165 in the IL-12p35 subunit as residues suitable for engineering substitutions. In additional, we generated additional combination variants incorporating substitutions identified in Example 2 which contributed the greatest reduction in potency.

In view of the above, we designed further IL-12p40 and IL-12p35 variants, illustrative sequences for which are depicted respectively in FIGS. 29 and 31. As above, plasmids coding for the IL-12p40 and IL-12p35 variants were constructed by standard gene synthesis, followed by subcloning into a pTT5 expression vector containing Fc fusion partners, corresponding amino acid sequences for which are depicted respectively in FIGS. 30 and 32. IL-12-Fc fusion proteins were generated with the additional variant IL-12 subunits, sequences for which are depicted in FIG. 33, and produced as generally described in Example 1B.

The activity of the additional variant IL-12-Fc fusions were investigated in a pSTAT4 assay as generally described above. In particular, human PBMCs were activated with 100 ng/ml anti-CD3 (OKT3) for 2 days. Activated PBMCs were then incubated with the indicated test articles at 37° C. for 15 minutes. Cells were then stained with anti-CD3-BUV395 (UCHT1), anti-CD4-BV605 (RPAT4), anti-CD8-AF700 (SKI), anti-CD25-BV510 (M-A251), anti-CD45RA-BV421 (HI100), and anti-CD56-PE (N901). Next, cells were permeabilized using PerFix EXPOSE (Beckman Coulter, Indianapolis, Ind.). Following permeabilization, cells were stained with anti-FoxP3-AF488 (259D) and anti-pSTAT4-AF647 (38/p-Stat4) and analyzed by flow cytometry. Data depicting pSTAT4 MFI on $CD4^+CD45RA^+CD25^+$ and $CD8^+CD45RA^-CD25^+$ T cells are depicted in FIGS. 34-35, and data depicting the EC50 (and fold decrease relative to WT IL-12-Fc XENP27201) are shown in FIG. 36. The data show that most of the IL-12-Fc fusions comprising variant IL-12p40 and/or IL-12p30 subunits exhibit decreased potency in inducing STAT4 phosphorylation.

2C: Engineering IL-12p40 and IL-12p35 Variants (Round 3)

In Example 2B, we found that IL-12-Fc fusion XENP29952 comprising IL-12p40(E59K) enabled a ~12 fold reduction, in contrast to IL-12-Fc fusion XENP28825 comprising IL-12p40(E59Q) which had only about 2-fold reduction in potency. Additionally, we noted that several double mutants comprising E59Q in the IL-12p40 subunit demonstrated >3.5 fold reduction in potency (e.g. XENP29953, XENP29954, and XENP29959). Further, we noted that while XENP28846 comprising IL-12p35(N151D) enabled increased potency, IL-12p35(D55Q/N151D) actually enabled ~2-fold reduction in potency, which indicated to us that modification of D55 in the IL-12p35 subunit contributes greatly to a reduction in potency. Accordingly, to further reduce the potency of IL-12-Fc fusions, we generated additional combination variants incorporating substitutions in Example 2B which contributed the greatest reduction in potency. In addition as in Example 2B, we further included non-isosteric substitutions, with a particular focus on larger residues such as lysine.

In view of the above, we designed further IL-12p40 and IL-12p35 variants, illustrative sequences for which are depicted respectively in FIGS. 37 and 38. IL-12-Fc fusion proteins were generated with the additional variant IL-12 subunits, sequences for which are depicted in FIG. 39, and produced as generally described in Example 1B. The activity of the additional variant IL-12-Fc fusions were investigated in a pSTAT4 assay as generally described above. Data depicting pSTAT4 MFI on $CD4^+CD45RA^+CD25^+$ and $CD8^+CD45RA^+CD25^+$ T cells are depicted in FIG. 40, and data depicting the EC50 (and fold decrease relative to WT IL-12-Fc XENP27201) are shown in FIG. 41. The data show that all of the new IL-12-Fc fusions comprising variant IL-12p40 and/or IL-12p30 subunits exhibited substantially decreased potency in inducing STAT4 phosphorylation. Notably, XENP30607 and XENP30608 exhibited ~100-fold decrease in potency in comparison to XENP27201.

2D: Engineering IL-12p40 and IL-12p35 Variants (Round 4)

We further engineered the IL-12p40 and IL-12p35 subunits both by incorporating additional variants found in Example 2 contribute to a shift in potency, and by further using non-isosteric substitutions, with a particular focus on larger residues such as lysine and tyrosine, to disrupt the interaction of IL-12p35, IL-12p40, and/or the IL-12 complex with the IL-12 receptors.

In addition, we performed further structural analysis in the MOE software based on surface exposure to identify additional residues in the IL-12p40 and IL-12p35 subunits at which to introduce modifications. We further identified residues R159 and K264 in the IL-12p40 subunit; and residues L75, L89, F96, M97, L124, M125, and 1171 in the IL-12p35 subunit. We used the earlier described approaches, as well as alanine substitutions (in line with the alanine scanning mutagenesis technique), to preliminarily investigate the effect of modifications at these additionally identified residues.

In view of the above, we designed further IL-12p40 and IL-12p35 variants, illustrative sequences for which are depicted respectively in FIGS. 42 and 43. IL-12-Fc fusion proteins were generated with the additional variant IL-12 subunits, sequences for which are depicted in FIG. 44, and produced as generally described in Example 1B.

The activity of the additional variant IL-12-Fc fusions were investigated in a pSTAT4 assay as generally described above. Data depicting pSTAT4 MFI on $CD4^+CD45RA^+CD25^+$, $CD4^+CD45RA^-CD25^+$, $CD8^+CD45RA^+CD25^+$, and $CD8^+CD45RA^-CD25^+$ T cells are depicted in FIG. 46, and data depicting the EC50 (and fold decrease relative to WT IL-12-Fc XENP27201) are shown in FIG. 47. The data show that all of the new IL-12-Fc fusions comprising variant IL-12p40 and/or IL-12p35 subunits exhibited substantially decreased potency in inducing STAT4 phosphorylation.

Example 3: Bivalent IL-12-Fc Fusions

We also conceived bivalent IL-12-Fc fusions. One such format is the bivalent N-terminal IL-12-Fc fusion format (FIGS. 48A-B) which comprises two identical monomers each comprising a scIL-12 complex recombinant fused to the N-terminus of a homodimeric Fc chain (optionally via a domain linker). Another such format is the bivalent C-terminal IL-12-Fc fusion format (FIGS. 48C-D) which comprises two identical monomers each comprising a scIL-12 complex recombinant fused to the C-terminus of a homodimeric Fc chain (optionally via a domain linker).

Example 4: Reduced Potency IL-12 Variants in Alternative IL-12-Fc Fusion Formats We also investigated the IL-12 variants in the context of additional IL-12-Fc fusion formats. Fusions in the scIL-12 (p40/p35)-Fc and $(scIL\text{-}12(p40/p35))_2$-Fc formats were generated with either WT IL-12p40 subunits or variant IL-12p40(E59K/K99E) subunits and produced as generally described in Example 1B (and sequences for which are depicted in FIGS. 49-50).

The activity of the IL-12-Fc fusions were investigated in a pSTAT4 assay as generally described above. In particular, human PBMCs were activated with 100 ng/ml anti-CD3 (OKT3) for 2 days at 37° C. Activated PBMCs were then incubated with the indicated test articles for 15 minutes at 37° C. Cells were then stained with anti-CD3-BUV395 (UCHT1), anti-CD4-BV605 (RPAT4), anti-CD8-AF700 (SKI), anti-CD25-BV711 (M-A251), anti-CD45RA-BV421 (HI100), and anti-CD56-PE (N901). Next, cells were permeabilized using PerFix EXPOSE (Beckman Coulter, Indianapolis, Ind.). Following permeabilization, cells were stained with anti-FoxP3-V450 (259D) and anti-pSTAT4-AF647 (38/p-Stat4) and analyzed by flow cytometry. Data depicting pSTAT4 MFI on $CD4^+CD45RA^+CD25^+$, $CD4^+CD45RA^+CD25^+$, $CD8^+CD45RA^+CD25^+$, and $CD8^+CD45RA^-CD25^+$ T cells are depicted in FIG. 51, and data depicting the EC50 (and fold decrease relative to WT IL-12-Fc XENP27201) are shown in FIG. 52. The data show that IL-12-Fc fusions in the various format demonstrated very similar potency, and the IL-12-Fc fusions in scIL-12 (p40/p35)-Fc and $(scIL\text{-}12(p40/p35))_2$-Fc fusions comprising variant IL-12p40(E59K/K99E) subunits demonstrated very similar potency to IL-12-Fc fusions in the IL-12-heteroFc format comprising variant IL-12p40(E59K/K99E) subunit.

Example 5: IL-12-Fc Fusions Enhance Allogeneic Anti-Tumor Effect of T Cells In Vivo Next, we investigated in vivo anti-tumor effect of the IL-12-Fc fusions of the invention. NOD SCID gamma (NSG) mice were engrafted intradermally with $3\times10^6$ pp-65 expressing MCF-7 cells in the right flank on Day −15. On Day 0, mice were engrafted intraperitoneally with 1.5×10$^6$ human PBMCs. Mice (n=15) were then treated on Days 0, 7, 14, and 21 with 0.03 mg/kg XENP29952, a reduced potency IL-12-Fc fusion in the IL-12-heteroFc format comprising variant IL-12p40(E59K). Controls (n=10) used were PBS and XENP16432 (a bivalent anti-PD-1 mAb, a checkpoint inhibitor which enhances anti-tumor activity by de-repressing the engrafted human T cells; sequences depicted in FIG. 53). Tumor volumes were monitored by caliper measurements, data for which are shown (days post 1$^1$ dose) in FIG. 54. Blood and serum were drawn on Days 7, 14, and 21 and analyzed by flow cytometry to investigate expansion of human lymphocytes, data for which are depicted in FIG. 55, as well as by U-PLEX Biomarker Group 1 Human Assays (Meso Scale, Rockville, Md.) for serum cytokine concentrations, data for which are depicted in FIG. 56.

The data show that the IL-12-heteroFc fusion XENP29952 had significantly enhanced expansion of CD45$^+$, CD3$^+$ T cells, CD4$^+$ T cells, CD8$^+$ T cells, and NK cells by Day 14 in comparison to both PBS control and checkpoint blockade by XENP16432 (statistics performed on log-transformed data using unpaired t-test). Notably, XENP29952 significantly enhanced anti-tumor activity by Day 11 as indicated by change in tumor volume (statistics performed on baseline corrected data using unpaired t-test). Furthermore, XENP29952 significantly enhanced secretion of IFNγ and CD25 by Day 7 in comparison to checkpoint blockade by XENP16432 (statistics performed on log-transformed date using unpaired t-test).

In addition to anti-tumor activity, the engrafted human PBMCs develop an autoimmune response against mouse cells and subsequently graft-versus-host disease (GVHD). Accordingly, it should be noted that while all the animals treated with XENP29952 were dead by Day 19, this was likely due to their succumbing to GVHD exacerbated by significantly enhanced expansion of human lymphocytes. This highlights the importance of reduced potency IL-12 variants not just for improving pharmacokinetics but also for improving therapeutic index.

Example 6: IL-12-Fc Fusions Demonstrate Modulated Activity In Vivo Correlating to In Vitro Potency As all the animals treated with XENP29952 in Example 5 were dead as a result of GVHD, we investigated the in vivo activity of IL-12-Fc fusions engineered with reduced potency IL-12 variants in a GVHD study.

NSG mice were engrafted with 10×10$^6$ human PBMCs via IV-OSP on Day −1 and dosed intraperitoneally on Days 0, 7, 14, and 21 with the following test articles: XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Body weights were assessed twice per week as an indicator of GVHD, data for which are depicted in FIG. 57 as a change in body weight (relative to initial body weight). Additionally, blood was drawn on Day 7, 10, 14, and 31 to investigate the activation of various T cell populations as indicated by PD-1 expression levels (data for which are depicted in FIGS. 58 and 59), and serum was drawn to investigate cytokine secretion (data for which are depicted in FIG. 60). Notably, the data show a dose response for the test articles (i.e. enhanced GVHD, T cell activation, and IFNγ secretion by 0.3 mg/kg dose in comparison to 0.03 mg/kg dose).

It was surprising that XENP31251, which appeared to be one of the weakest variants in inducing STAT4 phosphorylation on CD4$^+$ T cells in vitro (see FIGS. 46A-46B), was one of the stronger inducers of GVHD. Accordingly, we re-investigated the in vitro activity of the same illustrative reduced potency IL-12-Fc in a STAT4 phosphorylation assay as generally described above using two separate PBMC donors. Human PBMCs were activated with 1 μg/ml anti-CD3 (OKT3) for 2 days at 37° C. Activated PBMCs were then incubated with the indicated test articles at 37,C for 15 minutes.

Cells were then stained with anti-CD3-BUV395 (UCHT1), anti-CD4-BV605 (RPAT4), anti-CD8-AF700 (SKI), anti-CD25-BV510 (M-A251), anti-CD45-BV785, anti-CD45RA-BV421 (HI100), anti-CD16-PE (B73), and anti-CD56-PE (N901). Next, cells were permeabilized using PerFix EXPOSE (Beckman Coulter, Indianapolis, Ind.). Following permeabilization, cells were stained with anti-FoxP3-AF488 (259D) and anti-pSTAT4-AF647 (38/p-Stat4) and analyzed by flow cytometry. Induction of STAT4 phosphorylation on various lymphocyte populations in PBMCs from the two donors are depicted in FIG. 61 (data not shown for the second donor but incorporated by reference from FIG. 62 in 62/848,512). The data from both donors and across the various lymphocyte populations show a potency ladder with XENP29952 as the most potent variant, XENP31254 and XENP31258 as the least potent variants, and XENP30597 and XENP31251 falling in between. Notably, the degree of GVHD, T cell activation, and IFNγ secretion as induced by the reduced potency IL-12-Fc fusion variants in vivo correlated with the in vitro potency. For example, at 0.03 mg/kg dose, XENP29952 induced greater GVHD, T cell activation, and IFNγ secretion than all the reduced potency IL-12-Fc fusions, while XENP31254 and XENP31258 induced the least GVHD, T cell activation, and IFNγ secretion.

Example 7: IL-12-Fc Fusions Have Anti-Tumor Activity and Combine Productively with Checkpoint Blockade Next, we investigated the in vivo anti-tumor effect of combining the additional IL-12-Fc fusions as well as the effect of combining the IL-12-Fc fusions with checkpoint blockade. NSG mice were engrafted intradermally with $3\times10^6$ pp-65 expressing MCF-7 cells in the right flank on Day −15. On Day 0, mice were engrafted intraperitoneally with $5\times10^6$ human PBMCs. Mice were then treated on Days 0, 7, 14, and 21 with 0.1 mg/kg XENP31251 alone or in combination with 3.0 mg/kg anti-PD-1 mAb XENP16432. Controls used were PBS, 3.0 mg/kg XENP16432 alone, and XENP31258. Tumor volumes were monitored by caliper measurements, data for which are shown (days post $1^{st}$ dose) in FIG. 62. Blood was drawn on Days 7, 14, and 21 and analyzed by flow cytometry to investigate expansion of human lymphocytes, data for which are depicted in FIG. 63 for Day 14.

The data show that XENP31258 significantly enhanced anti-tumor activity by Day 14, and XENP31251 (alone or in combination with XENP16432) significantly enhanced anti-tumor activity (as indicated by change in tumor volume) by Day 16 in comparison to treatment with PBS (statistics performed on baseline corrected data using Mann-Whitney test). Notably, the data show that XENP31251 in combination with XENP16432 significantly enhanced anti-tumor activity by Day 21 in comparison to treatment with XENP16432 alone; and that treatment with XENP31251 in combination with XENP16432 significantly enhanced lymphocyte expansion in comparison to either XENP31251 or XENP16432 alone, indicating that IL-12-Fc fusions combine productively with checkpoint blockade.

Example 8: Removing Free Cysteine in IL-12p40 Subunit

The IL-12p40 subunit has a free cysteine at position 252 (numbered according to the Human IL-12 subunit beta (IL-12p40) mature form sequence as depicted in FIG. 1) which may bond with other free cysteines leading at least to heterogeneity and at worse to immunogenicity. Accordingly, IL-12p40 variants were engineered to remove the free cysteine, for example, by introducing C252S modification (although other substitutions may also be used). Modification of C252 (e.g. C252S) can be used alone or in combination with any other IL-12p40 variants, such as affinity or expression variants. Illustrative IL-12p40 variants comprising a modification at C252 to remove the free cysteine are depicted in FIG. 65. Illustrative IL-12-Fc fusions proteins were generated with the additional variant IL-12p40 subunits, sequences for which are depicted in FIG. 66, and produced as generally described in Example 1B.

The activity of the IL-12p40 variants engineered to remove the free cysteine were investigated in a pSTAT4 assay as generally described above in order to ascertain that removal of the free cysteine did not engender any change in activity. Activated PBMCs were incubated with the indicated test articles and pSTAT4 MFI on various populations were assessed, data for which are depicted in FIG. 67. The data show that the variants comprising the C252S modification demonstrated similar activity to the counterpart variant which did not comprise the C252S modification. Notably, for 3 of the 4 variants tested for which we engineered versions with and without the C252S mutation (i.e. D18K/E59K/K99E; D18K/E59K/K99E/K264E; and E59K/K99E), the C252S mutation appeared to slightly increase the potency of the IL-12-Fc fusions.

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only, and the application is to be limited only by the terms of the appended claims, along with the full scope of equivalents to which the claims are entitled.

SEQUENCE LISTING (467 sequences)

SEQ ID NO: 1 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 2 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 3 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 4 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 5 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 6 - protein, 522 aa, Homo sapiens
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSD

SEQ ID NO: 7 - protein, 862 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 8 - protein, 599 aa, Homo sapiens
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKAN

SEQ ID NO: 9 - protein, 5 aa, Artificial Sequence
  Description of Artificial Sequence: Synthetic peptide
GGGGS

SEQ ID NO: 10 - protein, 10 aa, Artificial Sequence
  Description of Artificial Sequence: Synthetic peptide
GGGGSGGGGS

SEQ ID NO: 11 - protein, 15 aa, Artificial Sequence
  Description of Artificial Sequence: Synthetic peptide
GGGGSGGGGSGGGGS

SEQ ID NO: 12 - protein, 20 aa, Artificial Sequence
  Description of Artificial Sequence: Synthetic peptide
GGGGSGGGGSGGGGSGGGGS

SEQ ID NO: 13 - protein, 25 aa, Artificial Sequence
  Description of Artificial Sequence: Synthetic peptide
GGGGSGGGGSGGGGSGGGGSGGGGS

SEQ ID NO: 14 - protein, 30 aa, Artificial Sequence
  Description of Artificial Sequence: Synthetic polypeptide
GGGGSGGGGSGGGGSGGGGSGGGGSGGGGS

SEQ ID NO: 15 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 16 - protein, 30 aa, Artificial Sequence
  Description of Artificial Sequence: Synthetic polypeptide
DPALVHQRPAPPGGGGSGGGGSGGGGSGGG

SEQ ID NO: 17 - protein, 5 aa, Artificial Sequence
  Description of Artificial Sequence: Synthetic peptide
GKPGS

SEQ ID NO: 18 - protein, 25 aa, Artificial Sequence
  Description of Artificial Sequence: Synthetic peptide
GKPGSGKPGSGKPGSGKPGSGKPGS

SEQ ID NO: 19 - protein, 30 aa, Artificial Sequence
  Description of Artificial Sequence: Synthetic polypeptide
GKPGSGKPGSGKPGSGKPGSGKPGSGKPGS

SEQ ID NO: 20 - protein, 5 aa, Artificial Sequence
  Description of Artificial Sequence: Synthetic peptide
GGGES

SEQ ID NO: 21 - protein, 231 aa, Artificial Sequence
  Description of Artificial Sequence: Synthetic polypeptide
  Backbone 1 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 231 aa, Artificial Sequence
  Description of Artificial Sequence: Synthetic polypeptide
  Backbone 1 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23 - protein, 231 aa, Artificial Sequence
  Description of Artificial Sequence: Synthetic polypeptide
  Backbone 2 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 231 aa, Artificial Sequence; identical to SEQ ID NO: 22
  Description of Artificial Sequence: Synthetic polypeptide
  Backbone monomer 2

SEQ ID NO: 25 - protein, 231 aa, Artificial Sequence; identical to SEQ ID NO: 23
  Description of Artificial Sequence: Synthetic polypeptide
  Backbone 3 monomer 1

SEQ ID NO: 26 - protein, 231 aa, Artificial Sequence
  Description of Artificial Sequence: Synthetic polypeptide
  Backbone 3 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 27 - protein, 231 aa, Artificial Sequence
  Description of Artificial Sequence: Synthetic polypeptide
  Backbone 4 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 28 - protein, 231 aa, Artificial Sequence
  Description of Artificial Sequence: Synthetic polypeptide
  Backbone 4 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 29 - protein, 231 aa, Artificial Sequence
  Description of Artificial Sequence: Synthetic polypeptide
  Backbone 5 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 231 aa, Artificial Sequence
  Description of Artificial Sequence: Synthetic polypeptide
  Backbone 5 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 31 - protein, 231 aa, Artificial Sequence
  Description of Artificial Sequence: Synthetic polypeptide
  Backbone 6 monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 231 aa, Artificial Sequence
  Description of Artificial Sequence: Synthetic polypeptide
  Backbone 6 monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 33 - protein, 231 aa, Artificial Sequence
  Description of Artificial Sequence: Synthetic polypeptide
  Backbone 7 monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 231 aa, Artificial Sequence
  Description of Artificial Sequence: Synthetic polypeptide
  Backbone 7 monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35 - protein, 229 aa, Artificial Sequence
  Description of Artificial Sequence: Synthetic polypeptide
  Backbone 8 monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 36 - protein, 229 aa, Artificial Sequence
  Description of Artificial Sequence: Synthetic polypeptide
  Backbone 8 monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 37 - protein, 228 aa, Artificial Sequence
  Description of Artificial Sequence: Synthetic polypeptide
  Backbone 9 monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 38 - protein, 228 aa, Artificial Sequence
  Description of Artificial Sequence: Synthetic polypeptide
  Backbone 9 monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 39 - protein, 228 aa, Artificial Sequence
  Description of Artificial Sequence: Synthetic polypeptide
  Backbone 10 monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 40 - protein, 228 aa, Artificial Sequence
  Description of Artificial Sequence: Synthetic polypeptide
  Backbone 10 monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 41 - protein, 231 aa, Artificial Sequence
  Description of Artificial Sequence: Synthetic polypeptide
  Backbone 11 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 42 - protein, 231 aa, Artificial Sequence
  Description of Artificial Sequence: Synthetic polypeptide
  Backbone 11 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 43 - protein, 231 aa, Artificial Sequence
  Description of Artificial Sequence: Synthetic polypeptide
  Backbone 12 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 231 aa, Artificial Sequence; identical to SEQ ID NO: 43
  Description of Artificial Sequence: Synthetic polypeptide
  Backbone 12 monomer 2

SEQ ID NO: 45 - protein, 231 aa, Artificial Sequence; identical to SEQ ID NO: 22
  Description of Artificial Sequence: Synthetic polypeptide
  Backbone 13 monomer 1

SEQ ID NO: 46 - protein, 231 aa, Artificial Sequence
  Description of Artificial Sequence: Synthetic polypeptide
  Backbone 13 monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 547 aa, Artificial Sequence
  Description of Artificial Sequence: Synthetic polypeptide
  Chain 1 (XenD22914) - human_IL12p40_(GGGGS)2_Fc(216)_IgG1_ pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 48 - protein, 438 aa, Artificial Sequence
  Description of Artificial Sequence: Synthetic polypeptide
  XENP27201 Chain 2 - human_IL12p35_(GGGGS)2_Fc(216)_IgG1_ C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 546 aa, Artificial Sequence
  Description of Artificial Sequence: Synthetic polypeptide
  XENP27202 Chain 1 - empty-Fc(216)_IgG1_pI(-)_Isosteric _A_C220S/PVA_/S267K/L368D/K370S_(GGGGS)2_human_IL12p40
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 50 - protein, 437 aa, Artificial Sequence
  Description of Artificial Sequence: Synthetic polypeptide
  XENP27202 Chain 2 - human_IL12p40-empty-Fc(216)_IgG1_ C220S/PVA_/S267K/S364K/E357Q_(GGGGS)2_human_IL12p35
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 51 - protein, 769 aa, Artificial Sequence
  Description of Artificial Sequence: Synthetic polypeptide
  Chain 1 - human_IL12p40_(GGGGS)5-human_IL12p35_(GGGGS)2 _(single-Chain)_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 52 - protein, 231 aa, Artificial Sequence; identical to SEQ ID NO: 21
  Description of Artificial Sequence: Synthetic polypeptide
  XENP27203 Chain 2 - empty-Fc(216)_IgG1_C220S/PVA_/S267K /S364K/E357Q

SEQ ID NO: 53 - protein, 769 aa, Artificial Sequence
  Description of Artificial Sequence: Synthetic polypeptide
  XENP27204 Chain 1 - human_IL12p35_(GGGGS)5-human_IL12p40 _(GGGGS)2_(single-Chain)_Fc(216)_IgG1_pI(-)_Isosteric _A_C220S/PVA_/S267K/L368D/K370S
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 54 - protein, 231 aa, Artificial Sequence; identical to SEQ ID NO: 21
  Description of Artificial Sequence: Synthetic polypeptide
  XENP27204 Chain 2 - empty-Fc(216)_IgG1_C220S/PVA_/S267K/ S364K/E357Q

SEQ ID NO: 55 - protein, 547 aa, Artificial Sequence; identical to SEQ ID NO: 47
  Description of Artificial Sequence: Synthetic polypeptide
  XENP27560 human_IL12p40_(GGGGS)2-Fc(216)_IgG1_pI(-)_ Isosteric_A_C220S/PVA_/S267K/L368D/K370S_homodimer

SEQ ID NO: 56 - protein, 438 aa, Artificial Sequence; identical to SEQ ID NO: 48
  Description of Artificial Sequence: Synthetic polypeptide
  XENP27561 human_IL12p35_(GGGGS)2_Fc(216)_IgG1_C220S/PVA_/S267K/ S364K/E357Q_homodimer

SEQ ID NO: 57 - protein, 306 aa, Artificial Sequence
  Description of Artificial Sequence: Synthetic polypeptide
  IL-12p40(N103D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 58 - protein, 306 aa, Artificial Sequence
  Description of Artificial Sequence: Synthetic polypeptide
  IL-12p40(N113D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 59 - protein, 306 aa, Artificial Sequence
  Description of Artificial Sequence: Synthetic polypeptide
  IL-12p40(N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 60 - protein, 306 aa, Artificial Sequence
  Description of Artificial Sequence: Synthetic polypeptide
  IL-12p40(N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 61 - protein, 306 aa, Artificial Sequence
  Description of Artificial Sequence: Synthetic polypeptide
  IL-12p40(N103D/N113D/N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 62 - protein, 306 aa, Artificial Sequence
  Description of Artificial Sequence: Synthetic polypeptide
  IL-12p40(Q42E)
IWELKKDVYVVELDWYPDAPGEMVVLTCDTPEEDGITWTLDESSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 63 - protein, 306 aa, Artificial Sequence
  Description of Artificial Sequence: Synthetic polypeptide
  IL-12p40(E45Q)
IWELKKDVYVVELDWYPDAPGEMVVLTCDTPEEDGITWTLDQSSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 64 - protein, 306 aa, Artificial Sequence
  Description of Artificial Sequence: Synthetic polypeptide
  IL-12p40(Q56E)
IWELKKDVYVVELDWYPDAPGEMVVLTCDTPEEDGITWTLDQSSEVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 65 - protein, 306 aa, Artificial Sequence
  Description of Artificial Sequence: Synthetic polypeptide
  IL-12p40(E59Q)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 66 - protein, 306 aa, Artificial Sequence
  Description of Artificial Sequence: Synthetic polypeptide
  IL-12p40(D62N)
IWELKKDVYVVELDWYPDAPGEMVVLTCDTPEEDGITWTLDQSSEVLGSGKTLTIQVKEFGNAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 67 - protein, 306 aa, Artificial Sequence
  Description of Artificial Sequence: Synthetic polypeptide
  IL-12p40(Q42E/E45Q)
IWELKKDVYVVELDWYPDAPGEMVVLTCDTPEEDGITWTLDESSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 68 - protein, 306 aa, Artificial Sequence
  Description of Artificial Sequence: Synthetic polypeptide
  IL-12p40(E45Q/Q56E)
IWELKKDVYVVELDWYPDAPGEMVVLTCDTPEEDGITWTLDQSSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 69 - protein, 306 aa, Artificial Sequence
  Description of Artificial Sequence: Synthetic polypeptide
  IL-12p40(Q42E/E59Q)
IWELKKDVYVVELDWYPDAPGEMVVLTCDTPEEDGITWTLDESSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 70 - protein, 306 aa, Artificial Sequence
  Description of Artificial Sequence: Synthetic polypeptide
  IL-12p40(Q56E/E59Q)
IWELKKDVYVVELDWYPDAPGEMVVLTCDTPEEDGITWTLDQSSEVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 71 - protein, 306 aa, Artificial Sequence
  Description of Artificial Sequence: Synthetic polypeptide
  IL-12p40(Q42E/E45Q/Q56E)
IWELKKDVYVVELDWYPDAPGEMVVLTCDTPEEDGITWTLDESSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 72 - protein, 306 aa, Artificial Sequence
  Description of Artificial Sequence: Synthetic polypeptide
  IL-12p40(E45Q/Q56E/E59Q)
IWELKKDVYVVELDWYPDAPGEMVVLTCDTPEEDGITWTLDQSSQVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 73 - protein, 306 aa, Artificial Sequence
  Description of Artificial Sequence: Synthetic polypeptide
  IL-12p40(D161N)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGNNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 74 - protein, 306 aa, Artificial Sequence
  Description of Artificial Sequence: Synthetic polypeptide
  IL-12p40(E73Q)
IWELKKDVYVVELDWYPDAPGEMVVLTCDTPEEDGITWTLDQSSEVLGSGKTLTIQVKEFGDAGQYTCHKGGQVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 75 - protein, 306 aa, Artificial Sequence
  Description of Artificial Sequence: Synthetic polypeptide
  IL-12p40(Q144E)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 76 - protein, 306 aa, Artificial Sequence
  Description of Artificial Sequence: Synthetic polypeptide
  IL-12p40(E262Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKRQKKDRVFTDKTSATVICRKNASISVRAQDRYYSSSWSEWASVPCS

SEQ ID NO: 77 - protein, 306 aa, Artificial Sequence
  Description of Artificial Sequence: Synthetic polypeptide
  IL-12p40(E100Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKQPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 78 - protein, 306 aa, Artificial Sequence
  Description of Artificial Sequence: Synthetic polypeptide
  IL-12p40(D18N)
IWELKKDVYVVELDWYPNAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 79 - protein, 306 aa, Artificial Sequence
  Description of Artificial Sequence: Synthetic polypeptide
  IL-12p40(E33Q)
IWELKKDVYVVELDWYPDAPGEMVVLTCDTPEQDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 80 - protein, 306 aa, Artificial Sequence
  Description of Artificial Sequence: Synthetic polypeptide
  IL-12p40(Q229E)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSREVEVSWEYPDTWSTPHSYFSLTFCVQVQGKSKREKKDRVFTDKTSATVICRKNASISVRAQDRYYSSSWSEWASVPCS

SEQ ID NO: 81 - protein, 306 aa, Artificial Sequence
  Description of Artificial Sequence: Synthetic polypeptide
  IL-12p40(E235Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWQYPDTWSTPHSYFSLTFCVQVQGKSKREKKDRVFTDKTSATVICRKNASISVRAQDRYYSSSWSEWASVPCS

SEQ ID NO: 82 - protein, 306 aa, Artificial Sequence
  Description of Artificial Sequence: Synthetic polypeptide
  IL-12p40(Q256N)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVNGKSKREKKDRVFTDKTSATVICRKNASISVRAQDRYYSSSWSEWASVPCS

SEQ ID NO: 83 - protein, 306 aa, Artificial Sequence
  Description of Artificial Sequence: Synthetic polypeptide
  IL-12p40(E299Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSQWASVPCS

SEQ ID NO: 84 - protein, 306 aa, Artificial Sequence
  Description of Artificial Sequence: Synthetic polypeptide
  IL-12p40(D87N)
IWELKKDVYVVELDWYPDAPGEMVVLTCDTPEEDGITWTLDQSSEVLGSGKTLTIQVKEFGDAGQYTCHKGGEVLSHSLLLLHKKENGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 85 - protein, 547 aa, Artificial Sequence
  Description of Artificial Sequence: Synthetic polypeptide
  XenD24752 human_IL12p40_N103D_(GGGGS)2-Fc(216)_IgG1 _pI(-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 86 - protein, 547 aa, Artificial Sequence
  Description of Artificial Sequence: Synthetic polypeptide
  XenD24753 human_IL12p40_N113D_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 87 - protein, 547 aa, Artificial Sequence
  Description of Artificial Sequence: Synthetic polypeptide
  XenD24754 human_IL12p40_N200D_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 88 - protein, 547 aa, Artificial Sequence
  Description of Artificial Sequence: Synthetic polypeptide
  XenD24755 human_IL12p40_N281D_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 89 - protein, 547 aa, Artificial Sequence
  Description of Artificial Sequence: Synthetic polypeptide
  XenD24756 human_IL12p40_N103D/N113D/N200D/N281D_(GGGGS)2-Fc (216)_IgG1_pI(-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 90 - protein, 547 aa, Artificial Sequence
  Description of Artificial Sequence: Synthetic polypeptide
  XenD24757 human_IL12p40_Q42E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDESSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 91 - protein, 547 aa, Artificial Sequence
  Description of Artificial Sequence: Synthetic polypeptide
  XenD24758 human_IL12p40_E45Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 92 - protein, 547 aa, Artificial Sequence
  Description of Artificial Sequence: Synthetic polypeptide
  XenD24759 human_IL12p40_Q56E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 93 - protein, 547 aa, Artificial Sequence
  Description of Artificial Sequence: Synthetic polypeptide
  Chain 1 (XenD24760) - human_IL12p40(E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 94 - protein, 547 aa, Artificial Sequence
  Description of Artificial Sequence: Synthetic polypeptide
  XenD24761 human_IL12p40_D62N_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGNAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 95 - protein, 547 aa, Artificial Sequence
  Description of Artificial Sequence: Synthetic polypeptide
  XenD24762 human_IL12p40_Q42E/E45Q_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDESSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 96 - protein, 547 aa, Artificial Sequence
  Description of Artificial Sequence: Synthetic polypeptide
  XenD24763 human_IL12p40_E45Q/Q56E_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 97 - protein, 547 aa, Artificial Sequence
  Description of Artificial Sequence: Synthetic polypeptide
  XenD24764 human_IL12p40_Q42E/E59Q_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDESSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 98 - protein, 547 aa, Artificial Sequence
  Description of Artificial Sequence: Synthetic polypeptide
  Chain 1 (XenD24765) - human_IL12p40(Q56E/E59Q)_(GGGGS)2_Fc (216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 99 - protein, 547 aa, Artificial Sequence
  Description of Artificial Sequence: Synthetic polypeptide
  XenD24766 human_IL12p40_Q42E/E45Q/Q56E_(GGGGS)2-Fc(216)_IgG1_ pI(-)_Isosteric_A_C220S/PVA_/S267K/L368D/K370S_pTT5
IWELKKDVYVVELDWYPDAPGEMVVLTCDTPEEDGITWTLDESSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 100 - protein, 547 aa, Artificial Sequence
  Description of Artificial Sequence: Synthetic polypeptide
  XenD24767 human_IL12p40_E45Q/Q56E/E59Q_(GGGGS)2-Fc(216)_IgG1 _pI(-)_Isosteric_A_C220S/PVA_/S267K/L368D/K370S_pTT5
IWELKKDVYVVELDWYPDAPGEMVVLTCDTPEEDGITWTLDQSSQVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 101 - protein, 547 aa, Artificial Sequence
  Description of Artificial Sequence: Synthetic polypeptide
  XenD24768 human_IL12p40_D161N_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGNNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 102 - protein, 547 aa, Artificial Sequence
  Description of Artificial Sequence: Synthetic polypeptide
  XenD24769 human_IL12p40_E73Q_(GGGGS)2-Fc(216)_IgG1_pI( -)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGQVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 103 - protein, 547 aa, Artificial Sequence
  Description of Artificial Sequence: Synthetic polypeptide
  XenD24770 human_IL12p40_Q144E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 104 - protein, 547 aa, Artificial Sequence
  Description of Artificial Sequence: Synthetic polypeptide
  XenD24771 human_IL12p40_E262Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKRQKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 105 - protein, 547 aa, Artificial Sequence
  Description of Artificial Sequence: Synthetic polypeptide
  XenD24772 human_IL12p40_E100Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKQPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 106 - protein, 547 aa, Artificial Sequence
  Description of Artificial Sequence: Synthetic polypeptide
  XenD24773 human_IL12p40_D18N_(GGGGS)2-Fc(216)_IgG1_pI(- )_Isosteric_A_C220S/PVA_/S267K/L368D/K370S_pTT5
IWELKKDVYVVELDWYPNAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 107 - protein, 547 aa, Artificial Sequence
  Description of Artificial Sequence: Synthetic polypeptide
  XenD24774 human_IL12p40_E33Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEQDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 108 - protein, 547 aa, Artificial Sequence
  Description of Artificial Sequence: Synthetic polypeptide
  XenD24775 human_IL12p40_Q229E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSREVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 109 - protein, 547 aa, Artificial Sequence
  Description of Artificial Sequence: Synthetic polypeptide
  XenD24776 human_IL12p40_E235Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWQYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 110 - protein, 547 aa, Artificial Sequence
  Description of Artificial Sequence: Synthetic polypeptide
  XenD24777 human_IL12p40_Q256E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVEGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 111 - protein, 547 aa, Artificial Sequence
  Description of Artificial Sequence: Synthetic polypeptide
  XenD24778 human_IL12p40_E299Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSQWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 112 - protein, 547 aa, Artificial Sequence
  Description of Artificial Sequence: Synthetic polypeptide
  XenD24792 human_IL12p40_D87N_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKENGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 113 - protein, 197 aa, Artificial Sequence
  Description of Artificial Sequence: Synthetic polypeptide
  IL-12p35(N71D)
RNLPVATPDPGMFPCLHHSQNLLRAVSNMLQKARQTLEFYPCTSEEIDHEDITKDKTSTVEACLPLELTKDESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 114 - protein, 197 aa, Artificial Sequence
  Description of Artificial Sequence: Synthetic polypeptide
  IL-12p35(N85D)
RNLPVATPDPGMFPCLHHSQNLLRAVSNMLQKARQTLEFYPCTSEEIDHEDITKDKTSTVEACLPLELTKNESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 115 - protein, 197 aa, Artificial Sequence
  Description of Artificial Sequence: Synthetic polypeptide
  IL-12p35(N195D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 116 - protein, 197 aa, Artificial Sequence
  Description of Artificial Sequence: Synthetic polypeptide
  IL-12p35(N71D/N85D/N195D)
RNLPVATPDPGMFPCLHHSQNLLRAVSNMLQKARQTLEFYPCTSEEIDHEDITKDKTSTVEACLPLELTKDESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 117 - protein, 197 aa, Artificial Sequence
  Description of Artificial Sequence: Synthetic polypeptide
  IL-12p35(E153Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSQTVPQKSSLEEPDFYKTKIKLCILLHAFRIRAVTIDRVMSYLNAS

SEQ ID NO: 118 - protein, 197 aa, Artificial Sequence
  Description of Artificial Sequence: Synthetic polypeptide
  IL-12p35(E38Q)
RNLPVATPDPGMFPCLHHSQNLLRAVSNMLQKARQTLQFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 119 - protein, 197 aa, Artificial Sequence
  Description of Artificial Sequence: Synthetic polypeptide
  IL-12p35(N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 120 - protein, 197 aa, Artificial Sequence
  Description of Artificial Sequence: Synthetic polypeptide
  IL-12p35(Q135E)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDENMLAVIDELMQALNFNSETVPQKSSLEEPDFYKTKIKLCILLHAFRIRAVTIDRVMSYLNAS

SEQ ID NO: 121 - protein, 197 aa, Artificial Sequence
  Description of Artificial Sequence: Synthetic polypeptide
  IL-12p35(Q35D)
RNLPVATPDPGMFPCLHHSQNLLRAVSNMLQKARDTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 122 - protein, 197 aa, Artificial Sequence
  Description of Artificial Sequence: Synthetic polypeptide
  IL-12p35(Q146E)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMEALNFNSETVPQKSSLEEPDFYKTKIKLCILLHAFRIRAVTIDRVMSYLNAS

SEQ ID NO: 123 - protein, 197 aa, Artificial Sequence
  Description of Artificial Sequence: Synthetic polypeptide
  IL-12p35(N76D)
RNLPVATPDPGMFPCLHHSQNLLRAVSNMLQKARQTLEFYPCTSEEIDHEDITKDKTSTVEACLPLELTKNESCLDSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 124 - protein, 197 aa, Artificial Sequence
  Description of Artificial Sequence: Synthetic polypeptide
  IL-12p35(E162Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLQEPDFYKTKIKLCILLHAFRIRAVTIDRVMSYLNAS

SEQ ID NO: 125 - protein, 197 aa, Artificial Sequence
  Description of Artificial Sequence: Synthetic polypeptide
  IL-12p35(E163Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEQPDFYKTKIKLCILLHAFRIRAVTIDRVMSYLNAS

SEQ ID NO: 126 - protein, 438 aa, Artificial Sequence
  Description of Artificial Sequence: Synthetic polypeptide
  XenD24779 human_IL12p35_N71D_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKDESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 438 aa, Artificial Sequence
  Description of Artificial Sequence: Synthetic polypeptide
  XenD24780 human_IL12p35_N85D_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 438 aa, Artificial Sequence
  Description of Artificial Sequence: Synthetic polypeptide
  XenD24781 human_IL12p35_N195D_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 438 aa, Artificial Sequence
  Description of Artificial Sequence: Synthetic polypeptide
  XenD24782 human_IL12p35_N71D/N85D/N195D_(GGGGS)2_Fc(216)_ IgG1_C220S/PVA_/S267K/S364K/E357Q_pTT5
RNLPVATPDPGMFPCLHHSQNLLRAVSNMLQKARQTLEFYPCTSEEIDHEDITKDKTSTVEACLPLELTKDESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 438 aa, Artificial Sequence
  Description of Artificial Sequence: Synthetic polypeptide
  XenD24783 human_IL12p35_E153Q_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSQTVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 438 aa, Artificial Sequence
  Description of Artificial Sequence: Synthetic polypeptide
  XenD24784 human_IL12p35_E38Q_(GGGGS)2_Fc(216)_IgG1_C220S/PVA_ /S267K/S364K/E357Q_pTT5
RNLPVATPDPGMFPCLHHSQNLLRAVSNMLQKARQTLQFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 438 aa, Artificial Sequence
  Description of Artificial Sequence: Synthetic polypeptide
  Chain 2 (XenD24785) - human_IL12p35(N151D)_(GGGGS)2_Fc(216) _IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 438 aa, Artificial Sequence
  Description of Artificial Sequence: Synthetic polypeptide
  XenD24786 human_IL12p35_Q135E_(GGGGS)2_Fc(216)_IgG1_C220S/ PVA_/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDENMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 438 aa, Artificial Sequence
  Description of Artificial Sequence: Synthetic polypeptide
  XenD24787 human_IL12p35_Q35D_(GGGGS)2_Fc(216)_IgG1_C220S/PVA_ /S267K/S364K/E357Q_pTT5
RNLPVATPDPGMFPCLHHSQNLLRAVSNMLQKARDTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 438 aa, Artificial Sequence
  Description of Artificial Sequence: Synthetic polypeptide
  XenD24788 human_IL12p35_Q146E_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMEALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 438 aa, Artificial Sequence
  Description of Artificial Sequence: Synthetic polypeptide
  XenD24789 human_IL12p35_N76D_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLDSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 438 aa, Artificial Sequence
  Description of Artificial Sequence: Synthetic polypeptide
  XenD24790 human_IL12p35_E162Q_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLQEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 438 aa, Artificial Sequence
  Description of Artificial Sequence: Synthetic polypeptide
  XenD24791 human_IL12p35_E163Q_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEQPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - protein, 547 aa, Artificial Sequence; identical to SEQ ID NO: 89
  Description of Artificial Sequence: Synthetic polypeptide
  XENP28820 Chain 1 (XenD24756) - human_IL12p40_N103D/N113D/ N200D/N281D_(GGGGS)2-Fc(216)_IgG1_pI(-)_Isosteric_A_ C220S/PVA_/S267K/L368D/K370S

SEQ ID NO: 140 - protein, 438 aa, Artificial Sequence; identical to SEQ ID NO: 129
  Description of Artificial Sequence: Synthetic polypeptide
  XENP28820 Chain 2 (XenD24782) - human_IL12p35_N71D/N85D/N195D _(GGGGS)2_Fc(216)_IgG1_C220S/PVA_/S267K/S364K/E357Q

SEQ ID NO: 141 - protein, 547 aa, Artificial Sequence; identical to SEQ ID NO: 112
  Description of Artificial Sequence: Synthetic polypeptide
  XENP28821 Chain 1 (XenD24792) - human_IL12p40_D87N_(GGGGS) 2-Fc(216)_IgG1_pI(-)_Isosteric_A_C220S/PVA_/S267K/L368D/ K370S

SEQ ID NO: 142 - protein, 438 aa, Artificial Sequence; identical to SEQ ID NO: 48
  Description of Artificial Sequence: Synthetic polypeptide
  XENP28821 Chain 2 (XenD22915) - human_IL12p35_(GGGGS)2_Fc (216)_IgG1_C220S/PVA_/S267K/S364K/E357Q

SEQ ID NO: 143 - protein, 547 aa, Artificial Sequence; identical to SEQ ID NO: 90
  Description of Artificial Sequence: Synthetic polypeptide
  XENP28822 Chain 1 (XenD24757) - human_IL12p40_Q42E_(GGGGS) 2-Fc(216)_IgG1_pI(-)_Isosteric_A_C220S/PVA_/S267K/L368D/ K370S

SEQ ID NO: 144 - protein, 438 aa, Artificial Sequence; identical to SEQ ID NO: 48
  Description of Artificial Sequence: Synthetic polypeptide
  XENP28822 Chain 2 (XenD22915) - human_IL12p35_(GGGGS)2_Fc (216)_IgG1_C220S/PVA_/S267K/S364K/E357Q

SEQ ID NO: 145 - protein, 547 aa, Artificial Sequence; identical to SEQ ID NO: 91
  Description of Artificial Sequence: Synthetic polypeptide
  XENP28823 Chain 1 (XenD24758) - human_IL12p40_E45Q_(GGGGS)2 -Fc(216)_IgG1_pI(-)_Isosteric_A_C220S/PVA_/S267K/L368D/K370S

SEQ ID NO: 146 - protein, 438 aa, Artificial Sequence; identical to SEQ ID NO: 48
  Description of Artificial Sequence: Synthetic polypeptide
  XENP28823 Chain 2 (XenD22915) - human_IL12p35_(GGGGS)2_Fc (216)_IgG1_C220S/PVA_/S267K/S364K/E357Q

SEQ ID NO: 147 - protein, 547 aa, Artificial Sequence; identical to SEQ ID NO: 92
  Description of Artificial Sequence: Synthetic polypeptide
  XENP28824 Chain 1 (XenD24759) - human_IL12p40_Q56E_(GGGGS)2 -Fc(216)_IgG1_pI(-)_Isosteric_A_C220S/PVA_/S267K/L368D/K370S

SEQ ID NO: 148 - protein, 438 aa, Artificial Sequence; identical to SEQ ID NO: 48
  Description of Artificial Sequence: Synthetic polypeptide
  XENP28824 Chain 2 (XenD22915) - human_IL12p35_(GGGGS)2_Fc (216)_IgG1_C220S/PVA_/S267K/S364K/E357Q

SEQ ID NO: 149 - protein, 547 aa, Artificial Sequence; identical to SEQ ID NO: 93
  Description of Artificial Sequence: Synthetic polypeptide
  XENP28825 Chain 1 (XenD24760) - human_IL12p40_E59Q_(GGGGS)2 -Fc(216)_IgG1_pI(-)_Isosteric_A_C220S/PVA_/S267K/L368D/K370S

SEQ ID NO: 150 - protein, 438 aa, Artificial Sequence; identical to SEQ ID NO: 48
  Description of Artificial Sequence: Synthetic polypeptide
  XENP28825 Chain 2 (XenD22915) - human_IL12p35_(GGGGS)2_Fc (216)_IgG1_C220S/PVA_/S267K/S364K/E357Q

SEQ ID NO: 151 - protein, 547 aa, Artificial Sequence; identical to SEQ ID NO: 94
  Description of Artificial Sequence: Synthetic polypeptide
  XENP28826 Chain 1 (XenD24761) - human_IL12p40_D62N_(GGGGS)2 -Fc(216)_IgG1_pI(-)_Isosteric_A_C220S/PVA_/S267K/L368D/K370S

SEQ ID NO: 152 - protein, 438 aa, Artificial Sequence; identical to SEQ ID NO: 48
  Description of Artificial Sequence: Synthetic polypeptide
  XENP28826 Chain 2 (XenD22915) - human_IL12p35_(GGGGS)2_Fc (216)_IgG1_C220S/PVA_/S267K/S364K/E357Q

SEQ ID NO: 153 - protein, 547 aa, Artificial Sequence; identical to SEQ ID NO: 95
  Description of Artificial Sequence: Synthetic polypeptide
  XENP28827 Chain 1 (XenD24762) - human_IL12p40_Q42E/E45Q_(GGGGS)2 -Fc(216)_IgG1_pI(-)_Isosteric_A_C220S/PVA_/S267K/L368D/K370S

SEQ ID NO: 154 - protein, 438 aa, Artificial Sequence; identical to SEQ ID NO: 48
  Description of Artificial Sequence: Synthetic polypeptide
  XENP28827 Chain 2 (XenD22915) - human_IL12p35_(GGGGS)2_Fc (216)_IgG1_C220S/PVA_/S267K/S364K/E357Q

SEQ ID NO: 155 - protein, 547 aa, Artificial Sequence; identical to SEQ ID NO: 96
  Description of Artificial Sequence: Synthetic polypeptide
  XENP28828 Chain 1 (XenD24763) - human_IL12p40_E45Q/Q56E_(GGGGS) 2-Fc(216)_IgG1_pI(-)_Isosteric_A_C220S/PVA_/S267K/L368D/K370S

SEQ ID NO: 156 - protein, 438 aa, Artificial Sequence; identical to SEQ ID NO: 48
  Description of Artificial Sequence: Synthetic polypeptide
  XENP28828 Chain 2 (XenD22915) - human_IL12p35_(GGGGS)2_Fc (216)_IgG1_C220S/PVA_/S267K/S364K/E357Q

SEQ ID NO: 157 - protein, 547 aa, Artificial Sequence; identical to SEQ ID NO: 97
  Description of Artificial Sequence: Synthetic polypeptide
  XENP28829 Chain 1 (XenD24764) - human_IL12p40_Q42E/E59Q_(GGGGS) 2-Fc(216)_IgG1_pI(-)_Isosteric_A_C220S/PVA_/S267K/L368D/K370S

SEQ ID NO: 158 - protein, 438 aa, Artificial Sequence; identical to SEQ ID NO: 48
  Description of Artificial Sequence: Synthetic polypeptide
  XENP28829 Chain 2 (XenD22915) - human_IL12p35_(GGGGS)2_Fc (216)_IgG1_C220S/PVA_/S267K/S364K/E357Q

SEQ ID NO: 159 - protein, 547 aa, Artificial Sequence; identical to SEQ ID NO: 98
  Description of Artificial Sequence: Synthetic polypeptide
  XENP28830 Chain 1 (XenD24765) - human_IL12p40_Q56E/E59Q_(GGGGS) 2-Fc(216)_IgG1_pI(-)_Isosteric_A_C220S/PVA_/S267K/L368D/K370S

SEQ ID NO: 160 - protein, 438 aa, Artificial Sequence; identical to SEQ ID NO: 48
  Description of Artificial Sequence: Synthetic polypeptide
  XENP28830 Chain 2 (XenD22915) - human_IL12p35_(GGGGS)2_Fc (216)_IgG1_C220S/PVA_/S267K/S364K/E357Q

SEQ ID NO: 161 - protein, 547 aa, Artificial Sequence; identical to SEQ ID NO: 99
  Description of Artificial Sequence: Synthetic polypeptide
  XENP28831 Chain 1 (XenD24766) - human_IL12p40_Q42E/E45Q/Q56E_ (GGGGS)2-Fc(216)_IgG1_pI(-)_Isosteric_A_C220S/PVA_/S267K /L368D/K370S

SEQ ID NO: 162 - protein, 438 aa, Artificial Sequence; identical to SEQ ID NO: 48
  Description of Artificial Sequence: Synthetic polypeptide
  XENP28831 Chain 2 (XenD22915) - human_IL12p35_(GGGGS)2_Fc (216)_IgG1_C220S/PVA_/S267K/S364K/E357Q

SEQ ID NO: 163 - protein, 547 aa, Artificial Sequence; identical to SEQ ID NO: 100
  Description of Artificial Sequence: Synthetic polypeptide
  XENP28832 Chain 1 (XenD24767) - human_IL12p40_E45Q/Q56E/E59Q _(GGGGS)2-Fc(216)_IgG1_pI(-)_Isosteric_A_C220S/PVA_/S267K/ L368D/K370S

SEQ ID NO: 164 - protein, 438 aa, Artificial Sequence; identical to SEQ ID NO: 48
  Description of Artificial Sequence: Synthetic polypeptide
  XENP28832 Chain 2 (XenD22915) - human_IL12p35_(GGGGS)2_Fc (216)_IgG1_C220S/PVA_/S267K/S364K/E357Q

SEQ ID NO: 165 - protein, 547 aa, Artificial Sequence; identical to SEQ ID NO: 101
  Description of Artificial Sequence: Synthetic polypeptide
  XENP28833 Chain 1 (XenD24768) - human_IL12p40_D161N_(GGGGS) 2-Fc(216)_IgG1_pI(-)_Isosteric_A_C220S/PVA_/S267K/L368D /K370S

SEQ ID NO: 166 - protein, 438 aa, Artificial Sequence; identical to SEQ ID NO: 48
  Description of Artificial Sequence: Synthetic polypeptide
  XENP28833 Chain 2 (XenD22915) - human_IL12p35_(GGGGS)2_Fc (216)_IgG1_C220S/PVA_/S267K/S364K/E357Q

SEQ ID NO: 167 - protein, 547 aa, Artificial Sequence; identical to SEQ ID NO: 102
  Description of Artificial Sequence: Synthetic polypeptide
  XENP28834 Chain 1 (XenD24769) - human_IL12p40_E73Q_(GGGGS)2 -Fc(216)_IgG1_pI(-)_Isosteric_A_C220S/PVA_/S267K/L368D /K370S

SEQ ID NO: 168 - protein, 438 aa, Artificial Sequence; identical to SEQ ID NO: 48
  Description of Artificial Sequence: Synthetic polypeptide
  XENP28834 Chain 2 (XenD22915) - human_IL12p35_(GGGGS)2_Fc (216)_IgG1_C220S/PVA_/S267K/S364K/E357Q

SEQ ID NO: 169 - protein, 547 aa, Artificial Sequence; identical to SEQ ID NO: 103
  Description of Artificial Sequence: Synthetic polypeptide
  XENP28835 Chain 1 (XenD24770) - human_IL12p40_Q144E_(GGGGS)2 -Fc(216)_IgG1_pI(-)_Isosteric_A_C220S/PVA_/S267K/L368D/K370S

SEQ ID NO: 170 - protein, 438 aa, Artificial Sequence; identical to SEQ ID NO: 48
  Description of Artificial Sequence: Synthetic polypeptide
  XENP28835 Chain 2 (XenD22915) - human_IL12p35_(GGGGS)2_Fc (216)_IgG1_C220S/PVA_/S267K/S364K/E357Q

SEQ ID NO: 171 - protein, 547 aa, Artificial Sequence; identical to SEQ ID NO: 104
  Description of Artificial Sequence: Synthetic polypeptide
  XENP28836 Chain 1 (XenD24771) - human_IL12p40_E262Q_(GGGGS)2 -Fc(216)_IgG1_pI(-)_Isosteric_A_C220S/PVA_/S267K/L368D/K370S

SEQ ID NO: 172 - protein, 438 aa, Artificial Sequence; identical to SEQ ID NO: 48
  Description of Artificial Sequence: Synthetic polypeptide
  XENP28836 Chain 2 (XenD22915) - human_IL12p35_(GGGGS)2_Fc (216)_IgG1_C220S/PVA_/S267K/S364K/E357Q

SEQ ID NO: 173 - protein, 547 aa, Artificial Sequence; identical to SEQ ID NO: 105
  Description of Artificial Sequence: Synthetic polypeptide
  XENP28837 Chain 1 (XenD24772) - human_IL12p40_E100Q_(GGGGS)2 -Fc(216)_IgG1_pI(-)_Isosteric_A_C220S/PVA_/S267K/L368D/K370S

SEQ ID NO: 174 - protein, 438 aa, Artificial Sequence; identical to SEQ ID NO: 48
  Description of Artificial Sequence: Synthetic polypeptide
  XENP28837 Chain 2 (XenD22915) - human_IL12p35_(GGGGS)2_Fc (216)_IgG1_C220S/PVA_/S267K/S364K/E357Q

SEQ ID NO: 175 - protein, 547 aa, Artificial Sequence; identical to SEQ ID NO: 106
  Description of Artificial Sequence: Synthetic polypeptide
  XENP28838 Chain 1 (XenD24773) - human_IL12p40_D18N_(GGGGS)2 -Fc(216)_IgG1_pI(-)_Isosteric_A_C220S/PVA_/S267K/L368D /K370S

SEQ ID NO: 176 - protein, 438 aa, Artificial Sequence; identical to SEQ ID NO: 48
  Description of Artificial Sequence: Synthetic polypeptide
  XENP28838 Chain 2 (XenD22915) - human_IL12p35_(GGGGS)2_Fc (216)_IgG1_C220S/PVA_/S267K/S364K/E357Q

SEQ ID NO: 177 - protein, 547 aa, Artificial Sequence; identical to SEQ ID NO: 107
  Description of Artificial Sequence: Synthetic polypeptide
  XENP28839 Chain 1 (XenD24774) - human_IL12p40_E33Q_(GGGGS)2 -Fc(216)_IgG1_pI(-)_Isosteric_A_C220S/PVA_/S267K/L368D /K370S

SEQ ID NO: 178 - protein, 438 aa, Artificial Sequence; identical to SEQ ID NO: 48
  Description of Artificial Sequence: Synthetic polypeptide
  XENP28839 Chain 2 (XenD22915) - human_IL12p35_(GGGGS)2_Fc (216)_IgG1_C220S/PVA_/S267K/S364K/E357Q

SEQ ID NO: 179 - protein, 547 aa, Artificial Sequence; identical to SEQ ID NO: 108
  Description of Artificial Sequence: Synthetic polypeptide
  XENP28840 Chain 1 (XenD24775) - human_IL12p40_Q229E_(GGGGS)2 -Fc(216)_IgG1_pI(-)_Isosteric_A_C220S/PVA_/S267K/L368D/K370S

SEQ ID NO: 180 - protein, 438 aa, Artificial Sequence; identical to SEQ ID NO: 48
  Description of Artificial Sequence: Synthetic polypeptide
  XENP28840 Chain 2 (XenD22915) - human_IL12p35_(GGGGS)2_Fc (216)_IgG1_C220S/PVA_/S267K/S364K/E357Q

SEQ ID NO: 181 - protein, 547 aa, Artificial Sequence; identical to SEQ ID NO: 109
  Description of Artificial Sequence: Synthetic polypeptide
  XENP28841 Chain 1 (XenD24776) - human_IL12p40_E235Q_(GGGGS)2 -Fc(216)_IgG1_pI(-)_Isosteric_A_C220S/PVA_/S267K/L368D/K370S

SEQ ID NO: 182 - protein, 438 aa, Artificial Sequence; identical to SEQ ID NO: 48
  Description of Artificial Sequence: Synthetic polypeptide
  XENP28841 Chain 2 (XenD22915) - human_IL12p35_(GGGGS)2_Fc (216)_IgG1_C220S/PVA_/S267K/S364K/E357Q

SEQ ID NO: 183 - protein, 547 aa, Artificial Sequence; identical to SEQ ID NO: 110
  Description of Artificial Sequence: Synthetic polypeptide
  XENP28842 Chain 1 (XenD24777) - human_IL12p40_Q256E_(GGGGS)2 -Fc(216)_IgG1_pI(-)_Isosteric_A_C220S/PVA_/S267K/L368D/K370S

SEQ ID NO: 184 - protein, 438 aa, Artificial Sequence; identical to SEQ ID NO: 48
  Description of Artificial Sequence: Synthetic polypeptide
  XENP28842 Chain 2 (XenD22915) - human_IL12p35_(GGGGS)2_Fc (216)_IgG1_C220S/PVA_/S267K/S364K/E357Q

SEQ ID NO: 185 - protein, 547 aa, Artificial Sequence; identical to SEQ ID NO: 111
  Description of Artificial Sequence: Synthetic polypeptide
  XENP28843 Chain 1 (XenD24778) - human_IL12p40_E299Q_(GGGGS)2 -Fc(216)_IgG1_pI(-)_Isosteric_A_C220S/PVA_/S267K/L368D/K370S

SEQ ID NO: 186 - protein, 438 aa, Artificial Sequence; identical to SEQ ID NO: 48
  Description of Artificial Sequence: Synthetic polypeptide
  XENP28843 Chain 2 (XenD22915) - human_IL12p35_(GGGGS)2_Fc (216)_IgG1_C220S/PVA_/S267K/S364K/E357Q

SEQ ID NO: 187 - protein, 547 aa, Artificial Sequence; identical to SEQ ID NO: 47
  Description of Artificial Sequence: Synthetic polypeptide
  XENP28844 Chain 1 (XenD22914) - human_IL12p40_(GGGGS)2-Fc (216)_IgG1_pI(-)_Isosteric_A_C220S/PVA_/S267K/L368D/K370S

SEQ ID NO: 188 - protein, 438 aa, Artificial Sequence; identical to SEQ ID NO: 130
  Description of Artificial Sequence: Synthetic polypeptide
  XENP28844 Chain 2 (XenD24783) - human_IL12p35_E153Q_(GGGGS)2 _Fc(216)_IgG1_C220S/PVA_/S267K/S364K/E357Q

SEQ ID NO: 189 - protein, 547 aa, Artificial Sequence; identical to SEQ ID NO: 47
  Description of Artificial Sequence: Synthetic polypeptide
  XENP28845 Chain 1 (XenD22914) - human_IL12p40_(GGGGS)2-Fc (216)_IgG1_pI(-)_Isosteric_A_C220S/PVA_/S267K/L368D/K370S

SEQ ID NO: 190 - protein, 438 aa, Artificial Sequence; identical to SEQ ID NO: 131
  Description of Artificial Sequence: Synthetic polypeptide
  XENP28845 Chain 2 (XenD24784) - human_IL12p35_E38Q_(GGGGS)2_Fc (216)_IgG1_C220S/PVA_/S267K/S364K/E357Q

SEQ ID NO: 191 - protein, 547 aa, Artificial Sequence; identical to SEQ ID NO: 47
  Description of Artificial Sequence: Synthetic polypeptide
  XENP28846 Chain 1 (XenD22914) - human_IL12p40_(GGGGS)2-Fc (216)_IgG1_pI(-)_Isosteric_A_C220S/PVA_/S267K/L368D/K370S

SEQ ID NO: 192 - protein, 438 aa, Artificial Sequence; identical to SEQ ID NO: 132
  Description of Artificial Sequence: Synthetic polypeptide
  XENP28846 Chain 2 (XenD24785) - human_IL12p35_N151D_(GGGGS)2_Fc (216)_IgG1_C220S/PVA_/S267K/S364K/E357Q

SEQ ID NO: 193 - protein, 547 aa, Artificial Sequence; identical to SEQ ID NO: 47
  Description of Artificial Sequence: Synthetic polypeptide
  XENP28847 Chain 1 (XenD22914) - human_IL12p40_(GGGGS)2-Fc (216)_IgG1_pI(-)_Isosteric_A_C220S/PVA_/S267K/L368D/K370S

SEQ ID NO: 194 - protein, 438 aa, Artificial Sequence; identical to SEQ ID NO: 133
  Description of Artificial Sequence: Synthetic polypeptide
  XENP28847 Chain 2 (XenD24786) - human_IL12p35_Q135E_(GGGGS)2_Fc (216)_IgG1_C220S/PVA_/S267K/S364K/E357Q

SEQ ID NO: 195 - protein, 547 aa, Artificial Sequence; identical to SEQ ID NO: 47
  Description of Artificial Sequence: Synthetic polypeptide
  XENP28848 Chain 1 (XenD22914) - human_IL12p40_(GGGGS)2-Fc (216)_IgG1_pI(-)_Isosteric_A_C220S/PVA_/S267K/L368D/K370S

SEQ ID NO: 196 - protein, 438 aa, Artificial Sequence; identical to SEQ ID NO: 134
  Description of Artificial Sequence: Synthetic polypeptide
  XENP28848 Chain 2 (XenD24787) - human_IL12p35_Q35D_(GGGGS)2_Fc (216)_IgG1_C220S/PVA_/S267K/S364K/E357Q

SEQ ID NO: 197 - protein, 547 aa, Artificial Sequence; identical to SEQ ID NO: 47
  Description of Artificial Sequence: Synthetic polypeptide
  XENP28849 Chain 1 (XenD22914) - human_IL12p40_(GGGGS)2-Fc (216)_IgG1_pI(-)_Isosteric_A_C220S/PVA_/S267K/L368D/K370S

SEQ ID NO: 198 - protein, 438 aa, Artificial Sequence; identical to SEQ ID NO: 135
  Description of Artificial Sequence: Synthetic polypeptide
  XENP28849 Chain 2 (XenD24788) - human_IL12p35_Q146E_(GGGGS)2_Fc (216)_IgG1_C220S/PVA_/S267K/S364K/E357Q

SEQ ID NO: 199 - protein, 547 aa, Artificial Sequence; identical to SEQ ID NO: 47
  Description of Artificial Sequence: Synthetic polypeptide
  XENP28850 Chain 1 (XenD22914) - human_IL12p40_(GGGGS)2-Fc (216)_IgG1_pI(-)_Isosteric_A_C220S/PVA_/S267K/L368D/K370S

SEQ ID NO: 200 - protein, 438 aa, Artificial Sequence; identical to SEQ ID NO: 136
  Description of Artificial Sequence: Synthetic polypeptide
  XENP28850 Chain 2 (XenD24789) - human_IL12p35_N76D_(GGGGS)2_Fc (216)_IgG1_C220S/PVA_/S267K/S364K/E357Q

SEQ ID NO: 201 - protein, 547 aa, Artificial Sequence; identical to SEQ ID NO: 47
  Description of Artificial Sequence: Synthetic polypeptide
  XENP28851 Chain 1 (XenD22914) - human_IL12p40_(GGGGS)2-Fc (216)_IgG1_pI(-)_Isosteric_A_C220S/PVA_/S267K/L368D/K370S

SEQ ID NO: 202 - protein, 438 aa, Artificial Sequence; identical to SEQ ID NO: 137
  Description of Artificial Sequence: Synthetic polypeptide
  XENP28851 Chain 2 (XenD24790) - human_IL12p35_E162Q_(GGGGS)2_Fc (216)_IgG1_C220S/PVA_/S267K/S364K/E357Q

SEQ ID NO: 203 - protein, 547 aa, Artificial Sequence; identical to SEQ ID NO: 47
  Description of Artificial Sequence: Synthetic polypeptide
  XENP28852 Chain 1 (XenD22914) - human_IL12p40_(GGGGS)2-Fc (216)_IgG1_pI(-)_Isosteric_A_C220S/PVA_/S267K/L368D/K370S

SEQ ID NO: 204 - protein, 438 aa, Artificial Sequence; identical to SEQ ID NO: 138
  Description of Artificial Sequence: Synthetic polypeptide
  XENP28852 Chain 2 (XenD24791) - human_IL12p35_E163Q_(GGGGS)2_Fc (216)_IgG1_C220S/PVA_/S267K/S364K/E357Q

SEQ ID NO: 205 - protein, 306 aa, Artificial Sequence
  Description of Artificial Sequence: Synthetic polypeptide
  IL12p40(E59K)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 206 - protein, 306 aa, Artificial Sequence
  Description of Artificial Sequence: Synthetic polypeptide
  IL12p40(E32Q/E59Q)
IWELKKDVYVVELDWYPDAPGEMVVLTCDTPQEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 207 - protein, 306 aa, Artificial Sequence
  Description of Artificial Sequence: Synthetic polypeptide
  IL12p40(D34N/E59Q)
IWELKKDVYVVELDWYPDAPGEMVVLTCDTPEENGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 208 - protein, 306 aa, Artificial Sequence
  Description of Artificial Sequence: Synthetic polypeptide
  IL12p40(E59Q/E187Q)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIQVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 209 - protein, 306 aa, Artificial Sequence
  Description of Artificial Sequence: Synthetic polypeptide
  IL12p40(S43E/E59Q)
IWELKKDVYVVELDWYPDAPGEMVVLTCDTPEEDGITWTLDQESEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 210 - protein, 306 aa, Artificial Sequence
  Description of Artificial Sequence: Synthetic polypeptide
  IL12p40(S43K/E59Q)
IWELKKDVYVVELDWYPDAPGEMVVLTCDTPEEDGITWTLDQKSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 211 - protein, 306 aa, Artificial Sequence
  Description of Artificial Sequence: Synthetic polypeptide
  IL12p40(E59Q/K163E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNEEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 212 - protein, 306 aa, Artificial Sequence
  Description of Artificial Sequence: Synthetic polypeptide
  IL12p40(E59Q/K99E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 213 - protein, 306 aa, Artificial Sequence
  Description of Artificial Sequence: Synthetic polypeptide
  IL12p40(E59Q/K258E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGESKREKKDRVFTDKTSATVICRKNASISVRAQDRYYSSSWSEWASVPCS

SEQ ID NO: 214 - protein, 306 aa, Artificial Sequence
  Description of Artificial Sequence: Synthetic polypeptide
  IL12p40(E59Q/K260E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSEREKKDRVFTDKTSATVICRKNASISVRAQDRYYSSSWSEWASVPCS

SEQ ID NO: 215 - protein, 547 aa, Artificial Sequence
  Description of Artificial Sequence: Synthetic polypeptide
  Chain 1 (XenD25922) - human_IL12p40(E59K)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 216 - protein, 547 aa, Artificial Sequence
  Description of Artificial Sequence: Synthetic polypeptide
  Chain 1 (XenD25923) - human_IL12p40(E32Q/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPQEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 217 - protein, 547 aa, Artificial Sequence
  Description of Artificial Sequence: Synthetic polypeptide
  Chain 1 (XenD25924) - human_IL12p40(D34N/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEENGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 218 - protein, 547 aa, Artificial Sequence
  Description of Artificial Sequence: Synthetic polypeptide
  Chain 1 (XenD25925) - human_IL12p40(E59Q/E187Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIQVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 219 - protein, 547 aa, Artificial Sequence
  Description of Artificial Sequence: Synthetic polypeptide
  Chain 1 (XenD25926) - human_IL12p40(S43E/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQESEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 220 - protein, 547 aa, Artificial Sequence
  Description of Artificial Sequence: Synthetic polypeptide
  Chain 1 (XenD25927) - human_IL12p40(S43K/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQKSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 221 - protein, 547 aa, Artificial Sequence
  Description of Artificial Sequence: Synthetic polypeptide
  Chain 1 (XenD25928) - human_IL12p40(E59Q/K163E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNEEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 222 - protein, 547 aa, Artificial Sequence
  Description of Artificial Sequence: Synthetic polypeptide
  Chain 1 (XenD25929) - human_IL12p40(E59Q/K99E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 223 - protein, 547 aa, Artificial Sequence
  Description of Artificial Sequence: Synthetic polypeptide
  Chain 1 (XenD25930) - human_IL12p40(E59Q/K258E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGESKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 224 - protein, 547 aa, Artificial Sequence
  Description of Artificial Sequence: Synthetic polypeptide
  Chain 1 (XenD25931) - human_IL12p40(E59Q/K260E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSEREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 225 - protein, 197 aa, Artificial Sequence
  Description of Artificial Sequence: Synthetic polypeptide
  IL12p35(N151D/E153Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSQTVPQKSSLEEPDFYKTKIKLCILLHAFRIRAVTIDRVMSYLNAS

SEQ ID NO: 226 - protein, 197 aa, Artificial Sequence
  Description of Artificial Sequence: Synthetic polypeptide
  IL12p35(E153K)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSKTVPQKSSLEEPDFYKTKIKLCILLHAFRIRAVTIDRVMSYLNAS

SEQ ID NO: 227 - protein, 197 aa, Artificial Sequence
  Description of Artificial Sequence: Synthetic polypeptide
  IL12p35(N151K)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFKSETVPQKSSLEEPDFYKTKIKLCILLHAFRIRAVTIDRVMSYLNAS

SEQ ID NO: 228 - protein, 197 aa, Artificial Sequence
  Description of Artificial Sequence: Synthetic polypeptide
  IL12p35(N151D/D165N)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPNFYKTKIKLCILLHAFRIRAVTIDRVMSYLNAS

SEQ ID NO: 229 - protein, 197 aa, Artificial Sequence
  Description of Artificial Sequence: Synthetic polypeptide
  IL12p35(Q130E/N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKREIFLDQNMLAVIDELMQALNFDSETVPQKSSLEEPDFYKTKIKLCILLHAFRIRAVTIDRVMSYLNAS

SEQ ID NO: 230 - protein, 197 aa, Artificial Sequence
  Description of Artificial Sequence: Synthetic polypeptide
  IL12p35(N151D/K158E)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQESSLEEPDFYKTKIKLCILLHAFRIRAVTIDRVMSYLNAS

SEQ ID NO: 231 - protein, 197 aa, Artificial Sequence
  Description of Artificial Sequence: Synthetic polypeptide
  IL12p35(E79Q/N151D)
RNLPVATPDPGMFPCLHHSQNLLRAVSNMLQKARQTLEFYPCTSEEIDHEDITKDKTSTVEACLPLELTKNESCLNSRQTSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 232 - protein, 197 aa, Artificial Sequence
  Description of Artificial Sequence: Synthetic polypeptide
  IL12p35(D55Q/N151D)
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 233 - protein, 197 aa, Artificial Sequence
  Description of Artificial Sequence: Synthetic polypeptide
  IL12p35(N136D/N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQDMLAVIDELMQALNFDSETVPQKSSLEEPDFYKTKIKLCILLHAFRIRAVTIDRVMSYLNAS

SEQ ID NO: 234 - protein, 197 aa, Artificial Sequence
  Description of Artificial Sequence: Synthetic polypeptide
  IL12p35(N21D/N151D)
RNLPVATPDPGMFPCLHHSQDLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 235 - protein, 197 aa, Artificial Sequence
  Description of Artificial Sequence: Synthetic polypeptide
  IL12p35(E143Q/N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDQLMQALNFDSETVPQKSSLEEPDFYKTKIKLCILLHAFRIRAVTIDRVMSYLNAS

SEQ ID NO: 236 - protein, 438 aa, Artificial Sequence
  Description of Artificial Sequence: Synthetic polypeptide
  Chain 2 (XenD25911) - human_IL12p35(N151D/E153Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSQTVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 438 aa, Artificial Sequence
  Description of Artificial Sequence: Synthetic polypeptide
  Chain 2 (XenD25912) - human_IL12p35(E153K)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSKTVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 438 aa, Artificial Sequence
  Description of Artificial Sequence: Synthetic polypeptide
  Chain 2 (XenD25913) - human_IL12p35(N151K)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFKSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 438 aa, Artificial Sequence
  Description of Artificial Sequence: Synthetic polypeptide
  Chain 2 (XenD25914) - human_IL12p35(N151D/D165N)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPNFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 438 aa, Artificial Sequence
  Description of Artificial Sequence: Synthetic polypeptide
  Chain 2 (XenD25915) - human_IL12p35(Q130E/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKREIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 438 aa, Artificial Sequence
  Description of Artificial Sequence: Synthetic polypeptide
  Chain 2 (XenD25916) - human_IL12p35(N151D/K158E)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQESSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 438 aa, Artificial Sequence
  Description of Artificial Sequence: Synthetic polypeptide
  Chain 2 (XenD25917) - human_IL12p35(E79Q/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRQTSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 438 aa, Artificial Sequence
  Description of Artificial Sequence: Synthetic polypeptide
  Chain 2 (XenD25918) - human_IL12p35(D55Q/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 438 aa, Artificial Sequence
  Description of Artificial Sequence: Synthetic polypeptide
  Chain 2 (XenD25919) - human_IL12p35(N136D/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQDMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - protein, 438 aa, Artificial Sequence
  Description of Artificial Sequence: Synthetic polypeptide
  Chain 2 (XenD25920) - human_IL12p35(N21D/N151D)_(GGGGS)2_Fc (216)_IgG1_C220S/PVA_/S267K/S364K/E357Q
RNLPVATPDPGMFPCLHHSQDLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 438 aa, Artificial Sequence
  Description of Artificial Sequence: Synthetic polypeptide
  Chain 2 (XenD25921) - human_IL12p35(E143Q/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDQLMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - protein, 5 aa, Artificial Sequence
  Description of Artificial Sequence: Synthetic peptide
GGGGA

SEQ ID NO: 248 - protein, 10 aa, Artificial Sequence
  Description of Artificial Sequence: Synthetic peptide
GGGGAGGGGA

SEQ ID NO: 249 - protein, 15 aa, Artificial Sequence
  Description of Artificial Sequence: Synthetic peptide
GGGGAGGGGAGGGGA

SEQ ID NO: 250 - protein, 20 aa, Artificial Sequence
  Description of Artificial Sequence: Synthetic peptide
GGGGAGGGGAGGGGAGGGGA

SEQ ID NO: 251 - protein, 25 aa, Artificial Sequence
  Description of Artificial Sequence: Synthetic peptide
GGGGAGGGGAGGGGAGGGGAGGGGA

SEQ ID NO: 252 - protein, 30 aa, Artificial Sequence
  Description of Artificial Sequence: Synthetic polypeptide
GGGGAGGGGAGGGGAGGGGAGGGGAGGGGA

SEQ ID NO: 253 - protein, 35 aa, Artificial Sequence
  Description of Artificial Sequence: Synthetic polypeptide
GGGGAGGGGAGGGGAGGGGAGGGGAGGGGAGGGGA

SEQ ID NO: 254 - protein, 306 aa, Artificial Sequence
  Description of Artificial Sequence: Synthetic polypeptide
  IL-12p40(N103D/N113D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 255 - protein, 306 aa, Artificial Sequence
  Description of Artificial Sequence: Synthetic polypeptide
  IL-12p40(N103D/N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 256 - protein, 306 aa, Artificial Sequence
  Description of Artificial Sequence: Synthetic polypeptide
  IL-12p40(N103D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 257 - protein, 306 aa, Artificial Sequence
  Description of Artificial Sequence: Synthetic polypeptide
  IL-12p40(N113D/N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 258 - protein, 306 aa, Artificial Sequence
  Description of Artificial Sequence: Synthetic polypeptide
  IL-12p40(N113D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 259 - protein, 306 aa, Artificial Sequence
  Description of Artificial Sequence: Synthetic polypeptide
  IL-12p40(N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 260 - protein, 306 aa, Artificial Sequence
  Description of Artificial Sequence: Synthetic polypeptide
  IL-12p40(N103D/N113D/N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 261 - protein, 306 aa, Artificial Sequence
  Description of Artificial Sequence: Synthetic polypeptide
  IL-12p40(N103D/N113D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 262 - protein, 306 aa, Artificial Sequence
  Description of Artificial Sequence: Synthetic polypeptide
  IL-12p40(N103D/N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 263 - protein, 306 aa, Artificial Sequence
  Description of Artificial Sequence: Synthetic polypeptide
  IL-12p40(N113D/N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 264 - protein, 306 aa, Artificial Sequence
  Description of Artificial Sequence: Synthetic polypeptide
  IL-12p40(N103Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 265 - protein, 306 aa, Artificial Sequence
  Description of Artificial Sequence: Synthetic polypeptide
  IL-12p40(N113Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 266 - protein, 306 aa, Artificial Sequence
  Description of Artificial Sequence: Synthetic polypeptide
  IL-12p40(N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 267 - protein, 306 aa, Artificial Sequence
  Description of Artificial Sequence: Synthetic polypeptide
  IL-12p40(N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 268 - protein, 306 aa, Artificial Sequence
  Description of Artificial Sequence: Synthetic polypeptide
  IL-12p40(N103Q/N113Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 269 - protein, 306 aa, Artificial Sequence
  Description of Artificial Sequence: Synthetic polypeptide
  IL-12p40(N103Q/N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 270 - protein, 306 aa, Artificial Sequence
  Description of Artificial Sequence: Synthetic polypeptide
  IL-12p40(N103Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 271 - protein, 306 aa, Artificial Sequence
  Description of Artificial Sequence: Synthetic polypeptide
  IL-12p40(N113Q/N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 272 - protein, 306 aa, Artificial Sequence
  Description of Artificial Sequence: Synthetic polypeptide
  IL-12p40(N113Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 273 - protein, 306 aa, Artificial Sequence
  Description of Artificial Sequence: Synthetic polypeptide
  IL-12p40(N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 274 - protein, 306 aa, Artificial Sequence
  Description of Artificial Sequence: Synthetic polypeptide
  IL-12p40(N103Q/N113Q/N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 275 - protein, 306 aa, Artificial Sequence
  Description of Artificial Sequence: Synthetic polypeptide
  IL-12p40(N103Q/N113Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 276 - protein, 306 aa, Artificial Sequence
  Description of Artificial Sequence: Synthetic polypeptide
  IL-12p40(N103Q/N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 277 - protein, 306 aa, Artificial Sequence
  Description of Artificial Sequence: Synthetic polypeptide
  IL-12p40(N113Q/N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 278 - protein, 306 aa, Artificial Sequence
  Description of Artificial Sequence: Synthetic polypeptide
  IL-12p40(N103Q/N113Q/N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 279 - protein, 197 aa, Artificial Sequence
  Description of Artificial Sequence: Synthetic polypeptide
  IL-12p35(N71Q)
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 280 - protein, 197 aa, Artificial Sequence
  Description of Artificial Sequence: Synthetic polypeptide
  IL-12p35(N85Q)
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 281 - protein, 197 aa, Artificial Sequence
  Description of Artificial Sequence: Synthetic polypeptide
  IL-12p35(N195Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 282 - protein, 197 aa, Artificial Sequence
  Description of Artificial Sequence: Synthetic polypeptide
  IL-12p35(N71Q/N85Q)
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 283 - protein, 197 aa, Artificial Sequence
  Description of Artificial Sequence: Synthetic polypeptide
  IL-12p35(N71Q/N195Q)
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 284 - protein, 197 aa, Artificial Sequence
  Description of Artificial Sequence: Synthetic polypeptide
  IL-12p35(N85Q/N195Q)
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 285 - protein, 197 aa, Artificial Sequence
  Description of Artificial Sequence: Synthetic polypeptide
  IL-12p35(N71Q/N85Q/N195Q)
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 286 - protein, 197 aa, Artificial Sequence
  Description of Artificial Sequence: Synthetic polypeptide
  IL-12p35(N71D/N85D)
RNLPVATPDPGMFPCLHHSQNLLRAVSNMLQKARQTLEFYPCTSEEIDHEDITKDKTSTVEACLPLELTKDESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 287 - protein, 197 aa, Artificial Sequence
  Description of Artificial Sequence: Synthetic polypeptide
  IL-12p35(N71D/N195D)
RNLPVATPDPGMFPCLHHSQNLLRAVSNMLQKARQTLEFYPCTSEEIDHEDITKDKTSTVEACLPLELTKDESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 288 - protein, 197 aa, Artificial Sequence
  Description of Artificial Sequence: Synthetic polypeptide
  IL-12p35(N85D/N195D)
RNLPVATPDPGMFPCLHHSQNLLRAVSNMLQKARQTLEFYPCTSEEIDHEDITKDKTSTVEACLPLELTKNESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 289 - protein, 438 aa, Artificial Sequence
  Description of Artificial Sequence: Synthetic polypeptide
  XENP33008 Chain 2 - human_IL12p35(N71Q/N85Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 438 aa, Artificial Sequence
  Description of Artificial Sequence: Synthetic polypeptide
  XENP33009 Chain 2 - human_IL12p35(N71Q/N195Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 547 aa, Artificial Sequence
  Description of Artificial Sequence: Synthetic polypeptide
  Chain 1 (XenD26411) - human_IL12p40_E59K/K99E_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 292 - protein, 547 aa, Artificial Sequence
  Description of Artificial Sequence: Synthetic polypeptide
  XENP30598 Chain 1 (XenD26412) - human_IL12p40_D34N/E59K_(GGGGS)2 _Fc(216)_IgG1_pI(-)_Isosteric_A_C220S/PVA_/S267K/L368D/K370S
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 293 - protein, 547 aa, Artificial Sequence
  Description of Artificial Sequence: Synthetic polypeptide
  XENP30599 Chain 1 (XenD26413) - human_IL12p40_D34N/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 294 - protein, 547 aa, Artificial Sequence
  Description of Artificial Sequence: Synthetic polypeptide
  XENP30600 Chain 1 (XenD26414) - human_IL12p40_D34K/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 295 - protein, 547 aa, Artificial Sequence
  Description of Artificial Sequence: Synthetic polypeptide
  Chain 1 (XenD26415) - human_IL12p40_E32Q/D34N/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 296 - protein, 547 aa, Artificial Sequence
  Description of Artificial Sequence: Synthetic polypeptide
  Chain 1 (XenD26416) - human_IL12p40_E32Q/D34K/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPQEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 297 - protein, 547 aa, Artificial Sequence
  Description of Artificial Sequence: Synthetic polypeptide
  Chain 1 (XenD26417) - human_IL12p40_E32K/D34N/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPKENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 298 - protein, 547 aa, Artificial Sequence
  Description of Artificial Sequence: Synthetic polypeptide
  Chain 1 (XenD26418) - human_IL12p40_E32K/D34K/E59K/K99E_ (GGGGS)2_Fc(216)_IgG1_pI(-)_Isosteric_A_C220S/PVA_/S267K /L368D/K370S
IWELKKDVYVVELDWYPDAPGEMVVLTCDTPKEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 299 - protein, 438 aa, Artificial Sequence
  Description of Artificial Sequence: Synthetic polypeptide
  Chain 2 (XenD26427) - human_IL12p35_D55Q_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 438 aa, Artificial Sequence
  Description of Artificial Sequence: Synthetic polypeptide
  XENP30609 Chain 2 (XenD26428) - human_IL12p35_D55K_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKKKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 547 aa, Artificial Sequence
  Description of Artificial Sequence: Synthetic polypeptide
  XENP31250 Chain 1 (XenD27070) - human_IL12p40(E59Y/K99E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 302 - protein, 547 aa, Artificial Sequence
  Description of Artificial Sequence: Synthetic polypeptide
  XENP31251 Chain 1 (XenD27071) - human_IL12p40(E59K/K99Y)_ (GGGGS)2_Fc(216)_IgG1_pI(-)_Isosteric_A_C220S/PVA_/S267K /L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 303 - protein, 547 aa, Artificial Sequence
  Description of Artificial Sequence: Synthetic polypeptide
  XENP31252 Chain 1 (XenD27072) - human_IL12p40(E59Y/K99Y)_ (GGGGS)2_Fc(216)_IgG1_pI(-)_Isosteric_A_C220S/PVA_/S267K /L368D/K370S
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 304 - protein, 547 aa, Artificial Sequence
  Description of Artificial Sequence: Synthetic polypeptide
  XENP31253 Chain 1 (XenD27073) - human_IL12p40(E45K/E59K/K99E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSKVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 305 - protein, 547 aa, Artificial Sequence
  Description of Artificial Sequence: Synthetic polypeptide
  XENP31254 Chain 1 (XenD27074) - human_IL12p40(D18K/E59K/K99E)_ (GGGGS)2_Fc(216)_IgG1_pI(-)_Isosteric_A_C220S/PVA_/S267K/ L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 306 - protein, 547 aa, Artificial Sequence
  Description of Artificial Sequence: Synthetic polypeptide
  XENP31255 Chain 1 (XenD27075) - human_IL12p40(E59K/K99E/Q144E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 307 - protein, 547 aa, Artificial Sequence
  Description of Artificial Sequence: Synthetic polypeptide
  XENP31256 Chain 1 (XenD27076) - human_IL12p40(E59K/K99E/Q144K)_ (GGGGS)2_Fc(216)_IgG1_pI(-)_Isosteric_A_C220S/PVA_/S267K/L368D /K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPKGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 308 - protein, 547 aa, Artificial Sequence
  Description of Artificial Sequence: Synthetic polypeptide
  XENP31257 Chain 1 (XenD27077) - human_IL12p40(E59K/K99E/R159E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVEGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 309 - protein, 547 aa, Artificial Sequence
  Description of Artificial Sequence: Synthetic polypeptide
  XENP31258 Chain 1 (XenD27078) - human_IL12p40(E59K/K99E/K264E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 310 - protein, 438 aa, Artificial Sequence
  Description of Artificial Sequence: Synthetic polypeptide
  XENP31259 Chain 2 (XenD27088) - human_IL12p35(F96A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSAMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 438 aa, Artificial Sequence
  Description of Artificial Sequence: Synthetic polypeptide
  XENP31260 Chain 2 (XenD27089) - human_IL12p35(M97A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFAMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 438 aa, Artificial Sequence
  Description of Artificial Sequence: Synthetic polypeptide
  XENP31261 Chain 2 (XenD27090) - human_IL12p35(L89A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCAASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 438 aa, Artificial Sequence
  Description of Artificial Sequence: Synthetic polypeptide
  XENP31262 Chain 2 (XenD27091) - human_IL12p35(L124A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLAMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 438 aa, Artificial Sequence
  Description of Artificial Sequence: Synthetic polypeptide
  XENP31263 Chain 2 (XenD27092) - human_IL12p35(M125A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLADPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 438 aa, Artificial Sequence
  Description of Artificial Sequence: Synthetic polypeptide
  XENP31264 Chain 2 (XenD27093) - human_IL12p35(L57A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCANSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 316 - protein, 438 aa, Artificial Sequence
  Description of Artificial Sequence: Synthetic polypeptide
  XENP31265 Chain 2 (XenD27094) - human_IL12p35(I171A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKAKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 547 aa, Artificial Sequence
  Description of Artificial Sequence: Synthetic polypeptide
  XENP32186 Chain 1 (XenD28173) - human_IL12p40(D18K/E59K/K99E /K264E)_(GGGGS)2_Fc(216)_IgG1_pI(-)_Isosteric_A_C220S/PVA_ /S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 318 - protein, 547 aa, Artificial Sequence
  Description of Artificial Sequence: Synthetic polypeptide
  XENP31142 Chain 1 (XenD24876) - human_IL12p40_(GGGGS)2_Fc (216)_IgG1_pI(-)_Isosteric_A_C220S/PVA_/S267K/L368D/K370S /M428L/N434S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 319 - protein, 438 aa, Artificial Sequence
  Description of Artificial Sequence: Synthetic polypeptide
  Chain 2 (XenD24877) - human_IL12p35_(GGGGS)2_IgG1_PVA _/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 320 - protein, 547 aa, Artificial Sequence
  Description of Artificial Sequence: Synthetic polypeptide
  XENP31143 Chain 1 (XenD27162) - human_IL12p40_E32Q/D34N/E59K/ K99E_(GGGGS)2_Fc(216)_IgG1_pI(-)_Isosteric_A_C220S/PVA_ /S267K/L368D/K370S/M428L/N434S
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 321 - protein, 547 aa, Artificial Sequence
  Description of Artificial Sequence: Synthetic polypeptide
  XENP31144 Chain 1 (XenD27163) - human_IL12p40_E32K/D34N/E59K/ K99E_(GGGGS)2_Fc(216)_IgG1_pI(-)_Isosteric_A_C220S/PVA_/ S267K/L368D/K370S/M428L/N434S
IWELKKDVYVVELDWYPDAPGEMVVLTCDTPKENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 322 - protein, 438 aa, Artificial Sequence
  Description of Artificial Sequence: Synthetic polypeptide
  Chain 2 (XenD27166) - human_IL12p35_D55Q_(GGGGS)2_IgG1_PVA _/S267K/S364K/E357Q/M428L/N434S
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 323 - protein, 547 aa, Artificial Sequence
  Description of Artificial Sequence: Synthetic polypeptide
  XENP31145 Chain 1 (XenD27164) - human_IL12p40_E32K/D34K/E59K /K99E_(GGGGS)2_Fc(216)_IgG1_pI(-)_Isosteric_A_C220S/ PVA_/S267K/L368D/K370S/M428L/N434S
IWELKKDVYVVELDWYPDAPGEMVVLTCDTPKEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 324 - protein, 547 aa, Artificial Sequence
  Description of Artificial Sequence: Synthetic polypeptide
  XENP31146 Chain 1 (XenD27165) - human_IL12p40_E59K/K99E_ (GGGGS)2_Fc(216)_IgG1_pI(-)_Isosteric_A_C220S/PVA _/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 325 - protein, 306 aa, Artificial Sequence
  Description of Artificial Sequence: Synthetic polypeptide
  IL12p40(E59K/K99E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 326 - protein, 306 aa, Artificial Sequence
  Description of Artificial Sequence: Synthetic polypeptide
  IL12p40(D34N/E59K)
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 327 - protein, 306 aa, Artificial Sequence
  Description of Artificial Sequence: Synthetic polypeptide
  IL12p40(D34N/E59K/K99E)
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 328 - protein, 306 aa, Artificial Sequence
  Description of Artificial Sequence: Synthetic polypeptide
  IL12p40(D34K/E59K/K99E)
IWELKKDVYVVELDWYPDAPGEMVVLTCDTPEEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 329 - protein, 306 aa, Artificial Sequence
  Description of Artificial Sequence: Synthetic polypeptide
  IL12p40(E32Q/D34N/E59K/K99E)
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 330 - protein, 306 aa, Artificial Sequence
  Description of Artificial Sequence: Synthetic polypeptide
  IL12p40(E32Q/D34K/E59K/K99E)
IWELKKDVYVVELDWYPDAPGEMVVLTCDTPQEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 331 - protein, 306 aa, Artificial Sequence
  Description of Artificial Sequence: Synthetic polypeptide
  IL12p40(E32K/D34N/E59K/K99E)
IWELKKDVYVVELDWYPDAPGEMVVLTCDTPKENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 332 - protein, 306 aa, Artificial Sequence
  Description of Artificial Sequence: Synthetic polypeptide
  IL12p40(E32K/D34K/E59K/K99E)
IWELKKDVYVVELDWYPDAPGEMVVLTCDTPKEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 333 - protein, 197 aa, Artificial Sequence
  Description of Artificial Sequence: Synthetic polypeptide
  IL12p35(D55Q)
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 334 - protein, 197 aa, Artificial Sequence
  Description of Artificial Sequence: Synthetic polypeptide
  IL12p35(D55K)
RNLPVATPDPGMFPCLHHSQNLLRAVSNMLQKARQTLEFYPCTSEEIDHEDITKKKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 335 - protein, 306 aa, Artificial Sequence
  Description of Artificial Sequence: Synthetic polypeptide
  IL12p40(E59Y/K99E)
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 336 - protein, 306 aa, Artificial Sequence
  Description of Artificial Sequence: Synthetic polypeptide
  IL12p40(E59K/K99Y)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 337 - protein, 306 aa, Artificial Sequence
  Description of Artificial Sequence: Synthetic polypeptide
  IL12p40(E59Y/K99Y)
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 338 - protein, 306 aa, Artificial Sequence
  Description of Artificial Sequence: Synthetic polypeptide
  IL12p40(E45K/E59K/K99E)
IWELKKDVYVVELDWYPDAPGEMVVLTCDTPEEDGITWTLDQSSKVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 339 - protein, 306 aa, Artificial Sequence
  Description of Artificial Sequence: Synthetic polypeptide
  IL12p40(D18K/E59K/K99E)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 340 - protein, 306 aa, Artificial Sequence
  Description of Artificial Sequence: Synthetic polypeptide
  IL12p40(E59K/K99E/Q144E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 341 - protein, 306 aa, Artificial Sequence
  Description of Artificial Sequence: Synthetic polypeptide
  IL12p40(E59K/K99E/Q144K)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPKGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 342 - protein, 306 aa, Artificial Sequence
  Description of Artificial Sequence: Synthetic polypeptide
  IL12p40(E59K/K99E/R159E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVEGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 343 - protein, 306 aa, Artificial Sequence
  Description of Artificial Sequence: Synthetic polypeptide
  IL12p40(E59K/K99E/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCS

SEQ ID NO: 344 - protein, 306 aa, Artificial Sequence
  Description of Artificial Sequence: Synthetic polypeptide
  IL12p40(D18K/E59K/K99E/K264E)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCS

SEQ ID NO: 345 - protein, 197 aa, Artificial Sequence
  Description of Artificial Sequence: Synthetic polypeptide
  IL12p35(F96A)
RNLPVATPDPGMFPCLHHSQNLLRAVSNMLQKARQTLEFYPCTSEEIDHEDITKDKTSTVEACLPLELTKNESCLNSRETSFITNGSCLASRKTSAMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 346 - protein, 197 aa, Artificial Sequence
  Description of Artificial Sequence: Synthetic polypeptide
  IL12p35(M97A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFAMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 347 - protein, 197 aa, Artificial Sequence
  Description of Artificial Sequence: Synthetic polypeptide
  IL12p35(L89A)
RNLPVATPDPGMFPCLHHSQNLLRAVSNMLQKARQTLEFYPCTSEEIDHEDITKDKTSTVEACLPLELTKNESCLNSRETSFITNGSCAASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 348 - protein, 197 aa, Artificial Sequence
  Description of Artificial Sequence: Synthetic polypeptide
  IL12p35(L124A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLAMDPKRQIFLDQNMLAVIDELMQALNFNSETVPQKSSLEEPDFYKTKIKLCILLHAFRIRAVTIDRVMSYLNAS

SEQ ID NO: 349 - protein, 197 aa, Artificial Sequence
  Description of Artificial Sequence: Synthetic polypeptide
  IL12p35(M125A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLADPKRQIFLDQNMLAVIDELMQALNFNSETVPQKSSLEEPDFYKTKIKLCILLHAFRIRAVTIDRVMSYLNAS

SEQ ID NO: 350 - protein, 197 aa, Artificial Sequence
  Description of Artificial Sequence: Synthetic polypeptide
  IL12p35(L75A)
RNLPVATPDPGMFPCLHHSQNLLRAVSNMLQKARQTLEFYPCTSEEIDHEDITKDKTSTVEACLPLELTKNESCANSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 351 - protein, 197 aa, Artificial Sequence
  Description of Artificial Sequence: Synthetic polypeptide
  IL12p35(I171A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKAKLCILLHAFRIRAVTIDRVMSYLNAS

SEQ ID NO: 352 - protein, 438 aa, Artificial Sequence
  Description of Artificial Sequence: Synthetic polypeptide
  XENP33010 Chain 2 - human_IL12p35(N85Q/N195Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 769 aa, Artificial Sequence
  Description of Artificial Sequence: Synthetic polypeptide
  XENP31291 human_IL12p40(E59K/K99E)_(GGGGS)5-human_IL12p35_ (GGGGS)2_Fc(216)_IgG1_pI(-)_Isosteric_A_C220S/PVA_/S267K /L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 354 - protein, 438 aa, Artificial Sequence
  Description of Artificial Sequence: Synthetic polypeptide
  XENP33011 Chain 2 - human_IL12p35(N71Q/N85Q/N195Q)_ (GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 442 aa, Artificial Sequence
  Description of Artificial Sequence: Synthetic polypeptide
  XENP016432 Nivolumab_H0L0_IgG1_PVA_/S267K Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 214 aa, Artificial Sequence
  Description of Artificial Sequence: Synthetic polypeptide
  XENP016432 Nivolumab_H0L0_IgG1_PVA_/S267K Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 357 - protein, 547 aa, Artificial Sequence
  Description of Artificial Sequence: Synthetic polypeptide
  XENP31582 Chain 1 - human_IL12p40(D18K/E59K/K99E) _(GGGGS)2_Fc(216)_IgG1_pI(-)_Isosteric_A_C220S/PVA_ /S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 358 - protein, 547 aa, Artificial Sequence
  Description of Artificial Sequence: Synthetic polypeptide
  XENP31583 Chain 1 - human_IL12p40(E59K/K99Y)_(GGGGS)2_Fc (216)_IgG1_pI(-)_Isosteric_A_C220S/PVA_/S267K/L368D/ K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 359 - protein, 547 aa, Artificial Sequence
  Description of Artificial Sequence: Synthetic polypeptide
  XENP31584 Chain 1 - human_IL12p40(E59K/K99E/K264E)_ (GGGGS)2_Fc(216)_IgG1_pI(-)_Isosteric_A_C220S/PVA_ /S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 360 - protein, 306 aa, Artificial Sequence
  Description of Artificial Sequence: Synthetic polypeptide
  IL-12p40(C252S)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 361 - protein, 306 aa, Artificial Sequence
  Description of Artificial Sequence: Synthetic polypeptide
  IL-12p40(D18K/E59K/K99E/C252S)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 362 - protein, 306 aa, Artificial Sequence
  Description of Artificial Sequence: Synthetic polypeptide
  IL-12p40(D18K/E59K/K99E/C252S/K264E)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 363 - protein, 306 aa, Artificial Sequence
  Description of Artificial Sequence: Synthetic polypeptide
  IL-12p40(E59K/K99Y/C252S)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 364 - protein, 306 aa, Artificial Sequence
  Description of Artificial Sequence: Synthetic polypeptide
  IL-12p40(E59K/K99E/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 365 - protein, 306 aa, Artificial Sequence
  Description of Artificial Sequence: Synthetic polypeptide
  IL-12p40(E59K/K99E/C252S)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 366 - protein, 306 aa, Artificial Sequence
  Description of Artificial Sequence: Synthetic polypeptide
  IL-12p40(E59K/K99E/N103Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 367 - protein, 306 aa, Artificial Sequence
  Description of Artificial Sequence: Synthetic polypeptide
  IL-12p40(E59K/K99E/N113Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 368 - protein, 306 aa, Artificial Sequence
  Description of Artificial Sequence: Synthetic polypeptide
  IL-12p40(E59K/K99E/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 369 - protein, 306 aa, Artificial Sequence
  Description of Artificial Sequence: Synthetic polypeptide
  IL-12p40(E59K/K99E/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 370 - protein, 306 aa, Artificial Sequence
  Description of Artificial Sequence: Synthetic polypeptide
  IL-12p40(E59K/K99E/N103Q/N113Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 371 - protein, 306 aa, Artificial Sequence
  Description of Artificial Sequence: Synthetic polypeptide
  IL-12p40(E59K/K99E/N103Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 372 - protein, 306 aa, Artificial Sequence
  Description of Artificial Sequence: Synthetic polypeptide
  IL-12p40(E59K/K99E/N103Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 373 - protein, 306 aa, Artificial Sequence
  Description of Artificial Sequence: Synthetic polypeptide
  IL-12p40(E59K/K99E/N113Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 374 - protein, 306 aa, Artificial Sequence
  Description of Artificial Sequence: Synthetic polypeptide
  IL-12p40(IL12p40_E59K/K99E/N113Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 375 - protein, 306 aa, Artificial Sequence
  Description of Artificial Sequence: Synthetic polypeptide
  IL-12p40(E59K/K99E/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 376 - protein, 306 aa, Artificial Sequence
  Description of Artificial Sequence: Synthetic polypeptide
  IL-12p40(E59K/K99E/N103Q/N113Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 377 - protein, 306 aa, Artificial Sequence
  Description of Artificial Sequence: Synthetic polypeptide
  IL-12p40(E59K/K99E/N103Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 378 - protein, 306 aa, Artificial Sequence
  Description of Artificial Sequence: Synthetic polypeptide
  IL-12p40(E59K/K99E/N113Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 379 - protein, 306 aa, Artificial Sequence
  Description of Artificial Sequence: Synthetic polypeptide
  IL-12p40(E59K/K99E/N103Q/N113Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 380 - protein, 547 aa, Artificial Sequence
  Description of Artificial Sequence: Synthetic polypeptide
  XENP32187 Chain 1 - human_IL12p40(D18K/E59K/K99E/C252S)_ (GGGGS)2_Fc(216)_IgG1_pI(-)_Isosteric_A_C220S/PVA_/ S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 381 - protein, 547 aa, Artificial Sequence
  Description of Artificial Sequence: Synthetic polypeptide
  XENP32188 Chain 1 - human_IL12p40(D18K/E59K/K99E/C252S/K264E) _(GGGGS)2_Fc(216)_IgG1_pI(-)_Isosteric_A_C220S/PVA_/S267K /L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 382 - protein, 547 aa, Artificial Sequence
  Description of Artificial Sequence: Synthetic polypeptide
  XENP32189 Chain 1 - human_IL12p40(E59K/K99Y/C252S) _(GGGGS)2_Fc(216)_IgG1_pI(-)_Isosteric_A_C220S/PVA _/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 383 - protein, 547 aa, Artificial Sequence
  Description of Artificial Sequence: Synthetic polypeptide
  XENP33011 Chain 1 - human_IL12p40(E59K/K99E/C252S/K264E) _(GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 384 - protein, 547 aa, Artificial Sequence
  Description of Artificial Sequence: Synthetic polypeptide
  XENP32191 Chain 1 - human_IL12p40(E59K/K99E/C252S) _(GGGGS)2_Fc(216)_IgG1_pI(-)_Isosteric_A_C220S/PVA _/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 385 - protein, 547 aa, Artificial Sequence
  Description of Artificial Sequence: Synthetic polypeptide
  XENP32991 IL-12p40(E59K/K99E/N103Q/C252S/K264E_(GGGGS)2 _Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 386 - protein, 547 aa, Artificial Sequence
  Description of Artificial Sequence: Synthetic polypeptide
  XENP32992 IL-12p40(E59K/K99E/N113Q/C252S/K264E_(GGGGS)2 _Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 387 - protein, 547 aa, Artificial Sequence
  Description of Artificial Sequence: Synthetic polypeptide
  XENP32993 IL-12p40(E59K/K99E/N200Q/C252S/K264E_(GGGGS)2_Fc (216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 388 - protein, 547 aa, Artificial Sequence
  Description of Artificial Sequence: Synthetic polypeptide
  XENP32994 IL-12p40(E59K/K99E/N281Q/C252S/K264E_(GGGGS)2_Fc (216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 389 - protein, 547 aa, Artificial Sequence
  Description of Artificial Sequence: Synthetic polypeptide
  XENP32995 IL-12p40(E59K/K99E/N103Q/N113Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 390 - protein, 547 aa, Artificial Sequence
  Description of Artificial Sequence: Synthetic polypeptide
  XENP32996 IL-12p40(E59K/K99E/N103Q/N200Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 391 - protein, 547 aa, Artificial Sequence
  Description of Artificial Sequence: Synthetic polypeptide
  XENP32997 IL-12p40(E59K/K99E/N103Q/N281Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 392 - protein, 547 aa, Artificial Sequence
  Description of Artificial Sequence: Synthetic polypeptide
  XENP32998 IL-12p40(E59K/K99E/N113Q/N200Q/C252S/K264E _(GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 393 - protein, 547 aa, Artificial Sequence
  Description of Artificial Sequence: Synthetic polypeptide
  XENP32999 IL-12p40(E59K/K99E/N113Q/N281Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 394 - protein, 547 aa, Artificial Sequence
  Description of Artificial Sequence: Synthetic polypeptide
  XENP33000 IL-12p40(E59K/K99E/N200Q/N281Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 395 - protein, 547 aa, Artificial Sequence
  Description of Artificial Sequence: Synthetic polypeptide
  XENP33001 IL-12p40(E59K/K99E/N103Q/N113Q/N200Q/C252S /K264E_(GGGGS)2_Fc(216)_IgG1_pI(-)_Isosteric_A_C220S /PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 396 - protein, 547 aa, Artificial Sequence
  Description of Artificial Sequence: Synthetic polypeptide
  XENP33002 IL-12p40(E59K/K99E/N103Q/N200Q/N281Q/C252S/ K264E_(GGGGS)2_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 397 - protein, 547 aa, Artificial Sequence
  Description of Artificial Sequence: Synthetic polypeptide
  XENP33003 IL-12p40(E59K/K99E/N113Q/N200Q/N281Q/C252S/ K264E_(GGGGS)2_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 398 - protein, 547 aa, Artificial Sequence
  Description of Artificial Sequence: Synthetic polypeptide
  XENP33004 IL-12p40(E59K/K99E/N103Q/N113Q/N200Q/N281Q/C252S /K264E_(GGGGS)2_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 399 - protein, 438 aa, Artificial Sequence
  Description of Artificial Sequence: Synthetic polypeptide
  XENP33005 Chain 2 - human_IL12p35(N71Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 438 aa, Artificial Sequence
  Description of Artificial Sequence: Synthetic polypeptide
  XENP33006 Chain 2 - human_IL12p35(N85Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 438 aa, Artificial Sequence
  Description of Artificial Sequence: Synthetic polypeptide
  XENP33007 Chain 2 - human_IL12p35(N195Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 438 aa, Artificial Sequence; identical to SEQ ID NO: 48
  Description of Artificial Sequence: Synthetic polypeptide
  XENP32187 Chain 2 - IL12p35_(GGGGS)2_Fc(216)_IgG1 _C220S/PVA_/S267K/S364K/E357Q

SEQ ID NO: 403 - protein, 438 aa, Artificial Sequence; identical to SEQ ID NO: 48
  Description of Artificial Sequence: Synthetic polypeptide
  XENP32188 Chain 2 - IL12p35_(GGGGS)2_Fc(216)_IgG1 _C220S/PVA_/S267K/S364K/E357Q

SEQ ID NO: 404 - protein, 438 aa, Artificial Sequence; identical to SEQ ID NO: 48
  Description of Artificial Sequence: Synthetic polypeptide
  XENP32189 Chain 2 - IL12p35_(GGGGS)2_Fc(216)_IgG1 _C220S/PVA_/S267K/S364K/E357Q

SEQ ID NO: 405 - protein, 438 aa, Artificial Sequence; identical to SEQ ID NO: 48
  Description of Artificial Sequence: Synthetic polypeptide
  XENP32190 Chain 2 - IL12p35_(GGGGS)2_Fc(216)_IgG1 _C220S/PVA_/S267K/S364K/E357Q

SEQ ID NO: 406 - protein, 438 aa, Artificial Sequence; identical to SEQ ID NO: 48
  Description of Artificial Sequence: Synthetic polypeptide
  XENP32191 Chain 2 - IL12p35_(GGGGS)2_Fc(216)_IgG1 _C220S/PVA_/S267K/S364K/E357Q

SEQ ID NO: 407 - protein, 438 aa, Artificial Sequence; identical to SEQ ID NO: 48
  Description of Artificial Sequence: Synthetic polypeptide
  XENP32991 Chain 2 - human_IL12p35_(GGGGS)2_Fc(216)_IgG1 _C220S/PVA_/S267K/S364K/E357Q

SEQ ID NO: 408 - protein, 438 aa, Artificial Sequence; identical to SEQ ID NO: 48
  Description of Artificial Sequence: Synthetic polypeptide
  XENP32992 Chain 2 - human_IL12p35_(GGGGS)2_Fc(216)_IgG1 _C220S/PVA_/S267K/S364K/E357Q

SEQ ID NO: 409 - protein, 438 aa, Artificial Sequence; identical to SEQ ID NO: 48
  Description of Artificial Sequence: Synthetic polypeptide
  XENP32993 Chain 2 - human_IL12p35_(GGGGS)2_Fc(216)_IgG1 _C220S/PVA_/S267K/S364K/E357Q

SEQ ID NO: 410 - protein, 438 aa, Artificial Sequence; identical to SEQ ID NO: 48
  Description of Artificial Sequence: Synthetic polypeptide
  XENP32994 Chain 2 - human_IL12p35_(GGGGS)2_Fc(216)_IgG1 _C220S/PVA_/S267K/S364K/E357Q

SEQ ID NO: 411 - protein, 438 aa, Artificial Sequence; identical to SEQ ID NO: 48
  Description of Artificial Sequence: Synthetic polypeptide
  XENP32995 Chain 2 - human_IL12p35_(GGGGS)2_Fc(216)_IgG1 _C220S/PVA_/S267K/S364K/E357Q

SEQ ID NO: 412 - protein, 438 aa, Artificial Sequence; identical to SEQ ID NO: 48
  Description of Artificial Sequence: Synthetic polypeptide
  XENP32996 Chain 2 - human_IL12p35_(GGGGS)2_Fc(216)_IgG1 _C220S/PVA_/S267K/S364K/E357Q

SEQ ID NO: 413 - protein, 438 aa, Artificial Sequence; identical to SEQ ID NO: 48
  Description of Artificial Sequence: Synthetic polypeptide
  XENP32997 Chain 2 - human_IL12p35_(GGGGS)2_Fc(216)_IgG1 _C220S/PVA_/S267K/S364K/E357Q

SEQ ID NO: 414 - protein, 438 aa, Artificial Sequence; identical to SEQ ID NO: 48
  Description of Artificial Sequence: Synthetic polypeptide
  XENP32998 Chain 2 - human_IL12p35_(GGGGS)2_Fc(216)_IgG1 _C220S/PVA_/S267K/S364K/E357Q

SEQ ID NO: 415 - protein, 438 aa, Artificial Sequence; identical to SEQ ID NO: 48
  Description of Artificial Sequence: Synthetic polypeptide
  XENP32999 Chain 2 - human_IL12p35_(GGGGS)2_Fc(216)_IgG1 _C220S/PVA_/S267K/S364K/E357Q

SEQ ID NO: 416 - protein, 438 aa, Artificial Sequence; identical to SEQ ID NO: 48
  Description of Artificial Sequence: Synthetic polypeptide
  XENP33000 Chain 2 - human_IL12p35_(GGGGS)2_Fc(216)_IgG1 _C220S/PVA_/S267K/S364K/E357Q

SEQ ID NO: 417 - protein, 438 aa, Artificial Sequence; identical to SEQ ID NO: 48
  Description of Artificial Sequence: Synthetic polypeptide
  XENP33001 Chain 2 - human_IL12p35_(GGGGS)2_Fc(216)_IgG1 _C220S/PVA_/S267K/S364K/E357Q

SEQ ID NO: 418 - protein, 438 aa, Artificial Sequence; identical to SEQ ID NO: 48
  Description of Artificial Sequence: Synthetic polypeptide
  XENP33002 Chain 2 - human_IL12p35_(GGGGS)2_Fc(216)_IgG1 _C220S/PVA_/S267K/S364K/E357Q

SEQ ID NO: 419 - protein, 438 aa, Artificial Sequence; identical to SEQ ID NO: 48
  Description of Artificial Sequence: Synthetic polypeptide
  XENP33003 Chain 2 - human_IL12p35_(GGGGS)2_Fc(216)_IgG1 _C220S/PVA_/S267K/S364K/E357Q

SEQ ID NO: 420 - protein, 438 aa, Artificial Sequence; identical to SEQ ID NO: 48
  Description of Artificial Sequence: Synthetic polypeptide
  XENP33004 Chain 2 - human_IL12p35_(GGGGS)2_Fc(216)_IgG1 _C220S/PVA_/S267K/S364K/E357Q

SEQ ID NO: 421 - protein, 438 aa, Artificial Sequence; identical to SEQ ID NO: 319
  Description of Artificial Sequence: Synthetic polypeptide
  XENP31582 Chain 2 - human_IL12p35_(GGGGS)2_Fc(216)_IgG1 _C220S/PVA_/S267K/S364K/E357Q/M428L/N434S

SEQ ID NO: 422 - protein, 438 aa, Artificial Sequence; identical to SEQ ID NO: 319
  Description of Artificial Sequence: Synthetic polypeptide
  XENP31583 Chain 2 - human_IL12p35_(GGGGS)2_Fc(216)_IgG1 _C220S/PVA_/S267K/S364K/E357Q/M428L/N434S

SEQ ID NO: 423 - protein, 438 aa, Artificial Sequence; identical to SEQ ID NO: 319
  Description of Artificial Sequence: Synthetic polypeptide
  XENP31584 Chain 2 - human_IL12p35_(GGGGS)2_Fc(216)_IgG1 _C220S/PVA_/S267K/S364K/E357Q/M428L/N434S

SEQ ID NO: 424 - protein, 769 aa, Artificial Sequence; identical to SEQ ID NO: 353
  Description of Artificial Sequence: Synthetic polypeptide
  XENP31290 Chain 1 - human_IL12p40(E59K/K99E)_(GGGGS)5-human_ IL12p35_(GGGGS)2_(single-chain)_Fc(216)_IgG1_pI(-)_ Isosteric_A_C220S/PVA_/S267K/L368D/K370S

SEQ ID NO: 425 - protein, 547 aa, Artificial Sequence; identical to SEQ ID NO: 383
  Description of Artificial Sequence: Synthetic polypeptide
  XENP32190 Chain 1 - human_IL12p40(E59K/K99E/C252S/K264E)_ (GGGGS)2_Fc(216)_IgG1_pI(-)_Isosteric_A_C220S/PVA_/ S267K/L368D/K370S

SEQ ID NO: 426 - protein, 547 aa, Artificial Sequence; identical to SEQ ID NO: 383
  Description of Artificial Sequence: Synthetic polypeptide
  XENP33005 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 427 - protein, 547 aa, Artificial Sequence; identical to SEQ ID NO: 383
  Description of Artificial Sequence: Synthetic polypeptide
  XENP33006 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 428 - protein, 547 aa, Artificial Sequence; identical to SEQ ID NO: 383
  Description of Artificial Sequence: Synthetic polypeptide
  XENP33007 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 429 - protein, 547 aa, Artificial Sequence; identical to SEQ ID NO: 383
  Description of Artificial Sequence: Synthetic polypeptide
  XENP33008 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 430 - protein, 547 aa, Artificial Sequence; identical to SEQ ID NO: 383
  Description of Artificial Sequence: Synthetic polypeptide
  XENP33009 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 431 - protein, 547 aa, Artificial Sequence; identical to SEQ ID NO: 383
  Description of Artificial Sequence: Synthetic polypeptide
  XENP33010 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 432 - protein, 20 aa, Artificial Sequence
  Description of Artificial Sequence: Synthetic peptide
  MISC_FEATURE (1)..(20): This sequence may encompass 0-5 "Gly Gly Gly Ser" repeating units
GGGSGGGSGGGSGGGSGGGS

SEQ ID NO: 433 - protein, 438 aa, Artificial Sequence; identical to SEQ ID NO: 48
  Description of Artificial Sequence: Synthetic polypeptide
  XENP29952 Chain 2 (XenD22915) - human_IL12p35_(GGGGS)2_Fc(216) _IgG1_C220S/PVA_/S267K/S364K/E357Q

SEQ ID NO: 434 - protein, 438 aa, Artificial Sequence; identical to SEQ ID NO: 48
  Description of Artificial Sequence: Synthetic polypeptide
  XENP29953 Chain 2 (XenD22915) - human_IL12p35_(GGGGS)2_Fc(216) _IgG1_C220S/PVA_/S267K/S364K/E357Q

SEQ ID NO: 435 - protein, 438 aa, Artificial Sequence; identical to SEQ ID NO: 48
  Description of Artificial Sequence: Synthetic polypeptide
  XENP29954 Chain 2 (XenD22915) - human_IL12p35_(GGGGS)2_Fc(216) _IgG1_C220S/PVA_/S267K/S364K/E357Q

SEQ ID NO: 436 - protein, 438 aa, Artificial Sequence; identical to SEQ ID NO: 48
  Description of Artificial Sequence: Synthetic polypeptide
  XENP29955 Chain 2 (XenD22915) - human_IL12p35_(GGGGS)2_Fc(216) _IgG1_C220S/PVA_/S267K/S364K/E357Q

SEQ ID NO: 437 - protein, 438 aa, Artificial Sequence; identical to SEQ ID NO: 48
  Description of Artificial Sequence: Synthetic polypeptide
  XENP29956 Chain 2 (XenD22915) - human_IL12p35_(GGGGS)2_Fc(216) _IgG1_C220S/PVA_/S267K/S364K/E357Q

SEQ ID NO: 438 - protein, 438 aa, Artificial Sequence; identical to SEQ ID NO: 48
  Description of Artificial Sequence: Synthetic polypeptide
  XENP29957 Chain 2 (XenD22915) - human_IL12p35_(GGGGS)2_Fc(216) _IgG1_C220S/PVA_/S267K/S364K/E357Q

SEQ ID NO: 439 - protein, 438 aa, Artificial Sequence; identical to SEQ ID NO: 48
  Description of Artificial Sequence: Synthetic polypeptide
  XENP29958 Chain 2 (XenD22915) - human_IL12p35_(GGGGS)2_Fc(216) _IgG1_C220S/PVA_/S267K/S364K/E357Q

SEQ ID NO: 440 - protein, 438 aa, Artificial Sequence; identical to SEQ ID NO: 48
  Description of Artificial Sequence: Synthetic polypeptide
  XENP29959 Chain 2 (XenD22915) - human_IL12p35_(GGGGS)2_Fc(216) _IgG1_C220S/PVA_/S267K/S364K/E357Q

SEQ ID NO: 441 - protein, 438 aa, Artificial Sequence; identical to SEQ ID NO: 48
  Description of Artificial Sequence: Synthetic polypeptide
  XENP29960 Chain 2 (XenD22915) - human_IL12p35_(GGGGS)2_Fc(216) _IgG1_C220S/PVA_/S267K/S364K/E357Q

SEQ ID NO: 442 - protein, 438 aa, Artificial Sequence; identical to SEQ ID NO: 48
  Description of Artificial Sequence: Synthetic polypeptide
  XENP29961 Chain 2 (XenD22915) - human_IL12p35_(GGGGS)2_Fc(216) _IgG1_C220S/PVA_/S267K/S364K/E357Q

SEQ ID NO: 443 - protein, 438 aa, Artificial Sequence; identical to SEQ ID NO: 48
  Description of Artificial Sequence: Synthetic polypeptide
  XENP30597 Chain 2 (XenD22915) - human_IL12p35_(GGGGS)2_Fc(216) _IgG1_C220S/PVA_/S267K/S364K/E357Q

SEQ ID NO: 444 - protein, 438 aa, Artificial Sequence; identical to SEQ ID NO: 48
  Description of Artificial Sequence: Synthetic polypeptide
  XENP30598 Chain 2 (XenD22915) - human_IL12p35_(GGGGS)2_Fc(216) _IgG1_C220S/PVA_/S267K/S364K/E357Q

SEQ ID NO: 445 - protein, 438 aa, Artificial Sequence; identical to SEQ ID NO: 48
  Description of Artificial Sequence: Synthetic polypeptide
  XENP30599 Chain 2 (XenD22915) - human_IL12p35_(GGGGS)2_Fc(216) _IgG1_C220S/PVA_/S267K/S364K/E357Q

SEQ ID NO: 446 - protein, 438 aa, Artificial Sequence; identical to SEQ ID NO: 48
  Description of Artificial Sequence: Synthetic polypeptide
  XENP30600 Chain 2 (XenD22915) - human_IL12p35_(GGGGS)2_Fc(216) _IgG1_C220S/PVA_/S267K/S364K/E357Q

SEQ ID NO: 447 - protein, 438 aa, Artificial Sequence; identical to SEQ ID NO: 48
  Description of Artificial Sequence: Synthetic polypeptide
  XENP30601 Chain 2 (XenD22915) - human_IL12p35_(GGGGS)2_Fc(216) _IgG1_C220S/PVA_/S267K/S364K/E357Q

SEQ ID NO: 448 - protein, 438 aa, Artificial Sequence; identical to SEQ ID NO: 48
  Description of Artificial Sequence: Synthetic polypeptide
  XENP30602 Chain 2 (XenD22915) - human_IL12p35_(GGGGS)2_Fc(216) _IgG1_C220S/PVA_/S267K/S364K/E357Q

SEQ ID NO: 449 - protein, 438 aa, Artificial Sequence; identical to SEQ ID NO: 48
  Description of Artificial Sequence: Synthetic polypeptide
  XENP30603 Chain 2 (XenD22915) - human_IL12p35_(GGGGS)2_Fc(216) _IgG1_C220S/PVA_/S267K/S364K/E357Q

SEQ ID NO: 450 - protein, 438 aa, Artificial Sequence; identical to SEQ ID NO: 48
  Description of Artificial Sequence: Synthetic polypeptide
  XENP30604 Chain 2 (XenD22915) - human_IL12p35_(GGGGS)2_Fc(216) _IgG1_C220S/PVA_/S267K/S364K/E357Q

SEQ ID NO: 451 - protein, 438 aa, Artificial Sequence; identical to SEQ ID NO: 48
  Description of Artificial Sequence: Synthetic polypeptide
  XENP31250 Chain 2 (XenD22915) - human_IL12p35_(GGGGS)2_Fc(216) _IgG1_C220S/PVA_/S267K/S364K/E357Q

SEQ ID NO: 452 - protein, 438 aa, Artificial Sequence; identical to SEQ ID NO: 48
  Description of Artificial Sequence: Synthetic polypeptide
  XENP31251 Chain 2 (XenD22915) - human_IL12p35_(GGGGS)2_Fc(216) _IgG1_C220S/PVA_/S267K/S364K/E357Q

SEQ ID NO: 453 - protein, 438 aa, Artificial Sequence; identical to SEQ ID NO: 48
  Description of Artificial Sequence: Synthetic polypeptide
  XENP31252 Chain 2 (XenD22915) - human_IL12p35_(GGGGS)2_Fc(216) _IgG1_C220S/PVA_/S267K/S364K/E357Q

SEQ ID NO: 454 - protein, 438 aa, Artificial Sequence; identical to SEQ ID NO: 48
  Description of Artificial Sequence: Synthetic polypeptide
  XENP31253 Chain 2 (XenD22915) - human_IL12p35_(GGGGS)2_Fc(216) _IgG1_C220S/PVA_/S267K/S364K/E357Q

SEQ ID NO: 455 - protein, 438 aa, Artificial Sequence; identical to SEQ ID NO: 48
  Description of Artificial Sequence: Synthetic polypeptide
  XENP31254 Chain 2 (XenD22915) - human_IL12p35_(GGGGS)2_Fc(216) _IgG1_C220S/PVA_/S267K/S364K/E357Q

SEQ ID NO: 456 - protein, 438 aa, Artificial Sequence; identical to SEQ ID NO: 48
  Description of Artificial Sequence: Synthetic polypeptide
  XENP31255 Chain 2 (XenD22915) - human_IL12p35_(GGGGS)2_Fc(216) _IgG1_C220S/PVA_/S267K/S364K/E357Q

SEQ ID NO: 457 - protein, 438 aa, Artificial Sequence; identical to SEQ ID NO: 48
  Description of Artificial Sequence: Synthetic polypeptide
  XENP31255 Chain 2 (XenD22915) - human_IL12p35_(GGGGS)2_Fc(216) _IgG1_C220S/PVA_/S267K/S364K/E357Q

SEQ ID NO: 458 - protein, 438 aa, Artificial Sequence; identical to SEQ ID NO: 48
  Description of Artificial Sequence: Synthetic polypeptide
  XENP31256 Chain 2 (XenD22915) - human_IL12p35_(GGGGS)2_Fc(216) _IgG1_C220S/PVA_/S267K/S364K/E357Q

SEQ ID NO: 459 - protein, 438 aa, Artificial Sequence; identical to SEQ ID NO: 48
  Description of Artificial Sequence: Synthetic polypeptide
  XENP31257 Chain 2 (XenD22915) - human_IL12p35_(GGGGS)2_Fc(216) _IgG1_C220S/PVA_/S267K/S364K/E357Q

SEQ ID NO: 460 - protein, 438 aa, Artificial Sequence; identical to SEQ ID NO: 48
  Description of Artificial Sequence: Synthetic polypeptide
  XENP31258 Chain 2 (XenD22915) - human_IL12p35_(GGGGS)2_Fc(216) _IgG1_C220S/PVA_/S267K/S364K/E357Q

SEQ ID NO: 461 - protein, 438 aa, Artificial Sequence; identical to SEQ ID NO: 48
  Description of Artificial Sequence: Synthetic polypeptide
  XENP32186 Chain 2 (XenD22915) - human_IL12p35_(GGGGS)2_Fc(216) _IgG1_C220S/PVA_/S267K/S364K/E357Q

SEQ ID NO: 462 - protein, 20 aa, Artificial Sequence
  Description of Artificial Sequence: Synthetic peptide
GKPGSGKPGSGKPGSGKPGS

SEQ ID NO: 463 - protein, 10 aa, Artificial Sequence
  Description of Artificial Sequence: Synthetic peptide
  MISC_FEATURE (1)..(10): This sequence may encompass 0-5 "Gly Ser" repeating units
GSGSGSGSGS

SEQ ID NO: 464 - protein, 25 aa, Artificial Sequence
  Description of Artificial Sequence: Synthetic peptide
  MISC_FEATURE (1)..(25): This sequence may encompass 0-5 "Gly Ser Gly Gly Ser" repeating units
GSGGSGSGGSGSGGSGSGGSGSGGS

SEQ ID NO: 465 - protein, 25 aa, Artificial Sequence
  Description of Artificial Sequence: Synthetic peptide
  MISC_FEATURE (1)..(25): This sequence may encompass 0-5 "Gly Gly Gly Gly Ser" repeating units
GGGGSGGGGSGGGGSGGGGSGGGGS

SEQ ID NO: 466 - protein, 4 aa, Artificial Sequence
  Description of Artificial Sequence: Synthetic peptide
EPKS

SEQ ID NO: 467 - protein, 231 aa, Artificial Sequence; identical to SEQ ID NO: 21
  Description of Artificial Sequence: Synthetic polypeptide
  XENP31290 Chain 2 - empty-Fc(216)_IgG1_C220S/PVA_/S267K/S364K /E357Q

What is claimed is:

1. A heterodimeric Fc fusion protein comprising:
a) a first fusion protein comprising a variant IL-12p40 subunit domain and a first Fc domain, wherein said IL-12p40 subunit domain is covalently attached to the N-terminus of said first Fc domain, wherein said variant IL-12p40 subunit domain comprises the amino acid sequence of SEQ ID NO:363, wherein said first Fc domain comprises the amino acid sequence of SEQ ID NO:42, wherein said IL-12p40 subunit domain is covalently attached to the N-terminus of said first Fc domain using a domain linker comprising the amino acid sequence of SEQ ID NO:107; and
b) a second fusion protein comprising an IL-12p35 subunit domain and a second Fc domain, wherein said IL-12p35 subunit domain is covalently attached to the N-terminus of said Fc domain, wherein said IL-12p35 subunit domain comprises the amino acid sequence of SEQ ID NO:2, wherein said second Fc domain comprises the amino acid sequence of SEQ ID NO:41, and wherein said IL-12p35 subunit domain is covalently attached to the N-terminus of said second Fc domain using a domain linker having the amino acid sequence of SEQ ID NO:10,
wherein said first and said second Fc domains comprise modifications promoting heterodimerization of said first and said second Fc domains.

2. A heterodimeric Fc fusion protein comprising:
a) a first fusion protein comprising a variant IL-12p40 subunit domain and a first Fc domain, wherein said IL-12p40 subunit domain is covalently attached to the N-terminus of said first Fc domain, wherein said first fusion protein comprises the amino acid sequence of SEQ ID NO:382 further comprising the amino acid substitutions M428L/N434S; and
b) a second fusion protein comprising an IL-12p35 subunit domain and a second Fc domain, wherein said IL-12p35 subunit domain is covalently attached to the N-terminus of said Fc domain, wherein said second fusion protein comprises the amino acid sequence of SEQ ID NO:404 further comprising the amino acid substitutions M428L/N434S,
wherein said first and said second Fc domains comprise modifications promoting heterodimerization of said first and said second Fc domains.

* * * * *

UNITED STATES PATENT AND TRADEMARK OFFICE
CERTIFICATE OF CORRECTION

| | | |
|---|---|---|
| PATENT NO. | : 11,358,999 B2 | Page 1 of 1 |
| APPLICATION NO. | : 16/592656 | |
| DATED | : June 14, 2022 | |
| INVENTOR(S) | : Bernett et al. | |

It is certified that error appears in the above-identified patent and that said Letters Patent is hereby corrected as shown below:

In the Claims

Claim 1, Column 179, Line 13: the linker SEQ ID No. should be 10 rather than 107.

Signed and Sealed this
Fourth Day of March, 2025

Coke Morgan Stewart
*Acting Director of the United States Patent and Trademark Office*